US011732303B2

(12) United States Patent
Bellane-Chantelot et al.

(10) Patent No.: US 11,732,303 B2
(45) Date of Patent: Aug. 22, 2023

(54) PROGNOSTIC MARKER FOR MYELOPROLIFERATIVE NEOPLASMS

(71) Applicant: Institut Gustave-Roussy, Villejuif (FR)

(72) Inventors: Christine Bellane-Chantelot, Nogent sur Marne (FR); Isabelle Plo, Etampes (FR); William Vainchenker, Paris (FR); Cécile Saint-Martin, Paris (FR); Antonio D Di Stefano, Rungis (FR); Joseph Saliba, Paris (FR)

(73) Assignee: Institut Gustave-Roussy, Villejuif (FR)

( * ) Notice: Subject to any disclaimer, the term of this patent is extended or adjusted under 35 U.S.C. 154(b) by 454 days.

(21) Appl. No.: 15/739,454

(22) PCT Filed: Jun. 24, 2016

(86) PCT No.: PCT/EP2016/064754
§ 371 (c)(1),
(2) Date: Sep. 7, 2018

(87) PCT Pub. No.: WO2016/207405
PCT Pub. Date: Dec. 29, 2016

(65) Prior Publication Data
US 2020/0239961 A1    Jul. 30, 2020

(30) Foreign Application Priority Data
Jun. 25, 2015    (EP) .................................... 15306001

(51) Int. Cl.
*C12Q 1/6886* (2018.01)
*G01N 33/574* (2006.01)

(52) U.S. Cl.
CPC ..... *C12Q 1/6886* (2013.01); *G01N 33/57426* (2013.01); *C12Q 2600/156* (2013.01)

(58) Field of Classification Search
None
See application file for complete search history.

(56) References Cited

U.S. PATENT DOCUMENTS

2016/0046990 A1* 2/2016 Hensel .................. C12Q 1/6883
506/9

FOREIGN PATENT DOCUMENTS

WO    2011059835 A2    5/2011
WO    2011098901 A1    8/2011

OTHER PUBLICATIONS

Klampfl et al. (Blood 2011 vol. 118 p. 167) (Year: 2011).*
Mitev et al. (Cancer Genet Cytogenet 1996 p. 68-70) (Year: 1996).*
Abdel-Wahab et al., "Genetic Analysis of Transforming Events that Convert Chronic Myeloproliferative Neoplasms to Leukemias," Cancer Research, vol. 70, pp. 447-452, Jan. 2010.
Abrahamsson et al., "Glycogen synthase kinase 3beta missplicing contributes to leukemia stem cell generation," PNAS, vol. 106, No. 10, Mar. 2009.
Bellanne-Chantelot et al., "Genetic and clinical implications of the Val617Phe JAK2 mutation in 72 families with myeloproliferative disorders," Blood, vol. 108, No. 1, pp. 346-352, Jul. 2006.
Bellanne-Chantelot et al., "The JAK2v617F mutation may be present several years before the occurrence of overt myeloproliferative disorders," Leukemia, vol. U.K. 22, pp. 450-451, 2008.
Bluteau et al., "Thrombocytopenia-associated mutations in the ANKRD26 regulatory region induce MAPK hyperactivation," The Journal of Clinical Investigation, vol. 124, No. 2, pp. 580-591, Feb. 2014.
Cabagnols et al., "A CALR Mutation Preceding BCR-ABL1 in an Atypical Myeloproliferative Neoplasm," The New England Journal of Medicine, vol. 372, No. 7, pp. 688-690, Feb. 2015.
Cabagnols et al., "Differential association of caireticulin type 1 and type 2 mutations with myelofibrosis and essential thrombocytemia: relevance for disease evolution," Leukemia, vol. 29, pp. 249-252, 2015.
Chou et al., "GSKIP is Homologous to the Axin GSK3beta Interaction Domain and Functions as a Negative Regulator of GSK3beta," Biochemistry, vol. 45, pp. 11379-11389, 2006.
Chou et al., "Trisomy 21-associated defects in human primative hematopoiesis revealed through induced pluripotent stem cells," PNAS, vol. 109, No. 43, pp. 17573-17578, Oct. 2012.
Cui et al., "Trisomy 14 as a Sole Chromosome Abnormality is Associated with Older Age, a Heterogenous Group of Myeloid Neoplasms with Dysplasia, and a Wide Spectrum of Disease Progression," vol. 2010, ID 365318, 7 pages, 2010.
Debili et al., "Characterization of a Bipotent Erythro-Megakaryocytic Progenitor in Human Bone Marrow," Blood, vol. 88, No. 4, pp. 1284-1296, Aug. 1996.
Delhommeau et al., "Mutation in TET2 in Myeloid Cancers," The New England Journal of Medicine, vol. 360, No. 22, pp. 2289-2301, May 2009.
Genovese et al., "Clonal Hematopoiesis and Blood-Cancer Risk Inferred from Blood DNA Sequence," The New England Journal of Medicine, vol. 371, pp. 2477-2487, Dec. 2014.

(Continued)

*Primary Examiner* — Katherine D Salmon
(74) *Attorney, Agent, or Firm* — Rouget F. Henschel; Potomac Law Group, PLLC

(57) ABSTRACT

The present inventors identified for the first time a germline genomic alteration that accounts for familial myeloproliferative neoplasms (MPN) and myeloid malignancies. More precisely, they identified a 700 kb germline duplication that proposes patients to essential thrombocythemia (ET) with a high frequency of evolution to myelofibrosis (MF), secondary myelodysplastic syndromes (MDS) or acute myeloid leukemia (AML). Two out of the 6 duplicated genes (namely ATG2B and GSKIP) have been shown to be overexpressed in hematopoietic progenitors, and this overexpression cooperates with classical mutations in JAK2, MPL, and CALR to generate the MPN phenotype. The presence of the 700 kb germline duplication is thus of poor prognosis for a MPN patient. The present invention discloses a method for detecting a predisposition of developing a MPN, as well as a prognostic method for assessing the probability that an ET-suffering patient will develop a myelofibrosis, a secondary MDS or an AML. It also discloses a treating method for delaying MPN worsening, said treating method involving the inhibition of the ATG2B and GSKIP duplicated genes.

Figure 1A:
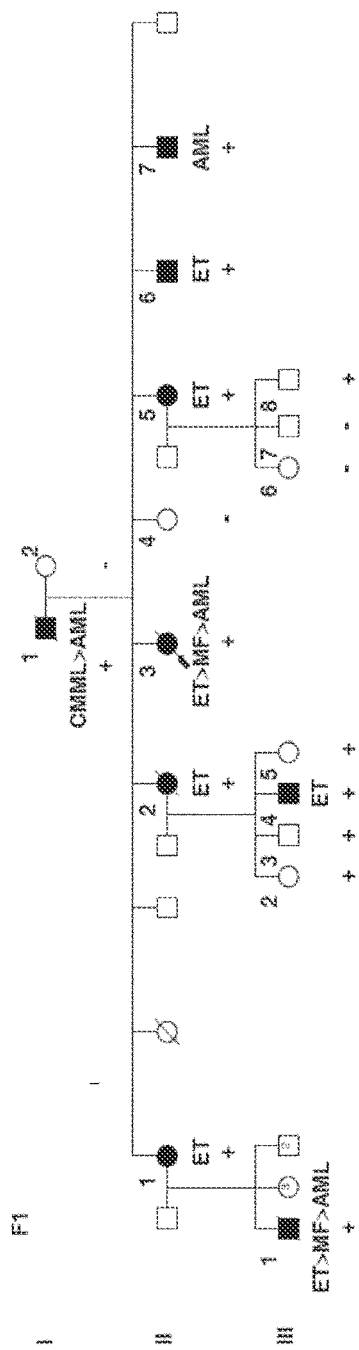

12 Claims, 22 Drawing Sheets
Specification includes a Sequence Listing.

(56) References Cited

OTHER PUBLICATIONS

Gore et al., "Somatic coding mutations in human induced pluripotent stem cells," Nature, vol. 471, pp. 63-67, Mar. 2011.
Hahn et al., "Heritable GATA2 mutations associated with familial myelodysplastic syndrome and acute myeloid leukemia," Nature Genetics, vol. 43, No. 10, pp. 1012-1017, Oct. 2011.
Harutyunyan et al., "Role of Germline Genetic Factors in MPN Pathogenesis," Hematology/Oncology Clinics of North America, vol. 26, pp. 1037-1051, 2012.
Jager et al., "Common germline variation at the TERT locus contributes to familial clustering of myeloproliferative neoplasms," American Journal of Hematology, vol. 89, No. 12, pp. 1107-1110, Dec. 2014.
Jaiswal et al., "Age-Related Clonal Hematopoiesis Associated with Adverse Outcomes," The New England Journal of Medicine, vol. 371, pp. 2488-2498, Dec. 2014.
James et al., "A unique clonal JAK2 mutation leading to constitutive signalling causes polycythaemia vera," Nature, vol. 434, pp. 1144-1148, Apr. 2005.
Jones et al., "Inherited predisposition to myeloproliferative neoplasms," Therapeutic Advances in Hematology, vol. 4, No. 4, pp. 237-253, 2013.
Kang et al., "Frameshift mutations of autophagy-related genes ATG2B, ATG5, ATG9B, and ATG12 in gastric andcolorectal cancers with microsatellite instability," Journal of Pathology, vol. 217, pp. 702-706, Dec. 2008.
Kishi-Itakura et al., "Ultrastructural analysis of autophagosome organization using mammalian autophagy-deficient cells," Journal of Cell Science, vol. 127, pp. 4089-4102, 2014.
Klampfl et al., "Genome integrity of myeloproliferative neoplasms in chronic phase and during disease progression," Blood, vol. 118, No. 1, pp. 167-176, Jul. 2011.
Klimchenko et al., "A common bipotent progenitor generates the erythroid and megakaryocyte lineages in embryonic stem cell-derived primitive hematopoiesis," Blood, vol. 114, No. 8, pp. 1506-1517, May 2009.
Krepischi et al., "Germline copy number variations and cancer predisposition," Future Oncology, vol. 8. pp, 441-450, 2012.
Kuiper et al., "Germline copy number variation and cancer risk," Current Opinion in Genetics and Development, vol. 20, pp. 282-289, Apr. 2010.
Li et al., "GSK3beta is a negative regulator of platelet function and thrombosis," Blood, vol. 111, No. 7, pp. 3522-3530, Apr. 2008.
Lin et al., "GSKIP, an inhibitor of GSKSbeta, Mediates the N-Cadherin/beta-Catenin Pool in the Differentiation of SH-SY5Y Cells," Journal of Cellular Biochemistry, vol. 108, pp. 1325-1336, 2009.
Livak et al., "Analysis of Relative Gene Expression Data Using Real-Time Quantitative PCR and the 2(-Delta Delta C (T)) Method," Methods, vol. 25, pp. 402-408, 2001.
Lundberg et al., "Clonal evolution and clinical correlates of somatic mutations in myeloproliferative neoplasms," Blood, vol. 123, No. 14, pp. 2220-2228, Apr. 2014.
Lundberg et al., "Myeloproliferative neoplasms can be initiated from a single hematopoietic stem cell expressing JAK2-V617F," The Journal of Experimental Medicine, vol. 211, pp. 2213-2230, Oct. 2014.
MacLean et al., "Altered hematopoiesis in trisomy 21 as revealed through in vitro differentiation of isogenic human pluripotent cells," PNAS, vol. 109, No. 43, pp. 17567-17572, Oct. 2012.
Malak et al., "Long term follow up of 93 families with myeloproliferative neoplasms: life expectancy and implications of JAK2V617F in the occurence of complications," Blood Cells, Molecules, and Diseases, vol. 49, pp. 170-176, 2012.
Mali et al., "Improved Efficiency and Pace of Generating Induced Pluripotent Stem Cells from Human Adult and Fetal Fibroblasts," Stem Cells, vol. 26, pp. 1998-2005, 2008.
Mancini et al., "Trisomy 14 in Hematologic Diseases—Another Non-Random Abnormality Within Myeloid Proliferative Disorders," vol. 66, pp. 39-42, 1993.
Mortensen et al., "Lack of autphagy in the hematopoietic system leads to loss of hematopoietic stem cell function and dysregulated myeloid proliferation," Autophagy, vol. 7, No. 9, pp. 1069-1070, Sep. 2011.
Olcaydu et al., "The role of the JAK2 GGCC haplotype and the TET2 gene in familial myeloproliferative neoplasms," Haematologica, vol. 96, No. 3, pp. 367-374, 2011.
Pasquet et al., "High frequency ofo GATA2 mutations in patients with mild chronic neutropenia evolving to MonoMac syndrome, myelodysplasia, and acute myeloid leukemia," Blood, vol. 121, No. 5, pp. 822-829, Jan. 2013.
Plo et al., "JAK2 stimulates homologous recombination and genetic instability: potential implication in the heterogeneity of myeloproliferative disorders," Blood, vol. 112, No. 4, Aug. 2008.
Prchal, "Bone-Marrow Responses in Polycythemia Vera," The New England Journal of Medicine, vol. 290, p. 1382, Jun. 1974.
Quinlan et al., "Genome Sequencing of Mouse Induced Pluripotent Stem Cells Reveals Retroelement Stability and Infrequent DNA Rearrangement during Reprogramming," Cell Stem Cell, vol. 9, pp. 366-373, Oct. 2011.
Rumi et al., "CALR exon 9 mutations are somatically acquired events in familial cases of essential thrombocythemia or primary myelofibrosis," Blood, vol. 123, pp. 2416-2419, Apr. 2014.
Saint-Martin et al., "Analysis of the Ten-Eleven Translocation 2 (TET2) gene in familial myeloproliferative neoplasms," Blood, vol. 114, No. 8, Aug. 2009.
Saliba et al., "Heterozygous and Homozygous JAK2 v617f States Modeled by Induced Pluripotent Stem Ceils from Myeloproliferative Neoplasm Patients," PLOS One, vol. 8, Issue 9, pp. e74257, Sep. 2013.
Smith et al., "Mutation of CEBOA in Familial Acute Myeloid Leukemia," The New England Journal of Medicine, vol. 351, No. 23, pp. 2403-2407, Dec. 2004.
Soda et al., "Inhibition of GSK-3beta promotes survival and proliferation of megakaryocytic cells through a beta-catenin-independent pathway," Cellular Signaling, vol. 20, pp. 2317-2323, Sep. 2008.
Song et al., "Haploinsufficiency of CBFA2 causes familial thrombocytopenia with propensity to develop acute myelogenous leukaemia," Nature Genetics, vol. 23, pp. 166-169, Oct. 1999.
Takahashi et al., "Induction of Pluripotent Stem Cells from Adult Human Fibroblasts by Defined Factors," Cell, vol. 131, pp. 861-872, Nov. 2007.
Takayama et al., "Generation of functional platelets from human embryonic stem cells in vitro via ES-sacs, VEGF-promoted structures that concentrate hematopoietic progenitors," Blood, vol. 111, No. 11, Jun. 2008.
Tefferi et al., "Proposals and rationale for revision of the World Health Organization diagnostic criteria for polycythemia vera, essential thrombocythemia, and primary myelofribrosis: recommendations from an ad hoc international expert panel," Blood, vol. 110, No. 4, pp. 1092-1097, Aug. 2007.
Vodyanik et al., "Human embryonic stem cell-derived CD34+ cells: efficient production in the coculture with OP9 stromal cells and analysis of lymphohematopoietic potential," Blood, vol. 106, No. 2, pp. 617-626, Sep. 2004.
Warr et al., "FOXO3A directs a protective autophagy program in haematopoietic stem cells," Nature, vol. 494, pp. 323-327, Feb. 2013.
Xie et al., "Age-related mutations associated with clonal hematopoietic expansion and malignancies," Nature Medicine, vol. 20, pp. 1472-1478, Dec. 2014.
Yamada et al., "Emergence of a BCR-ABL Translocation in a Patient with the JAK2V617F Mutation: Evidence for Secondary Acquistion of BCR-ABL in the JAK2V617F Clone," Journal of Clinical Oncology, vol. 32, No. 21, Jul. 2014.
Yoshida et al., "The landscape of somatic mutations in Down syndrome-related myeloid disorders," Nature Genetics, vol. 45, No. 11, pp. 1293-1299, Nov. 2013.
Bernheim et al., "Cytogenomics of cancers: From chromosome to sequence," Molecular Oncology, vol. 4, No. 4, pp. 309-322, Aug. 2010.

(56) References Cited

OTHER PUBLICATIONS

International Search Report issued in application No. PCT/EP2016/064754 dated Sep. 26, 2016.
Opalinska et al., "A High Resolution Epigenomic Map of Myelofibrosis Reveals Multiple Chromosomal Deletions and Amplifications Accompanied by a High Level of Functionally Important Methylation," 48th Annual Meeting of the American Society of Hematology, Orlando, Florida, Dec. 9-12, 2006 (Abstract).
Rhyasen et al., "Deregulation of microRNA's in myelodysplastic syndrome," Leukemia, vol. 26, No. 1, pp. 13-22, Aug. 2011.
Rice et al., "Analysis of genomic aberrations and gene expression profiling identifies novel lesions and pathways in myeloproliferative neoplasms," Blood Cancer Journal, vol. 1, No. 11, p. e40, Nov. 2011.
Saliba et al., "Germline duplication of ATG2B and GSKIP predisposes to familial myeloid maliganancies," Nature Genetics, vol. 47, No. 10, pp. 1131-1140, Aug. 2015 (Abstract).
Stegelman et al., "SNP-Array Profiling Identifies Complex Aberrations and Candidate Genes in Myeloproliferative Neoplasms with Leukemic Transformation," 51st ASH Annual Meeting and Exposition, Dec. 8, 2009.

\* cited by examiner

FIG. 5E
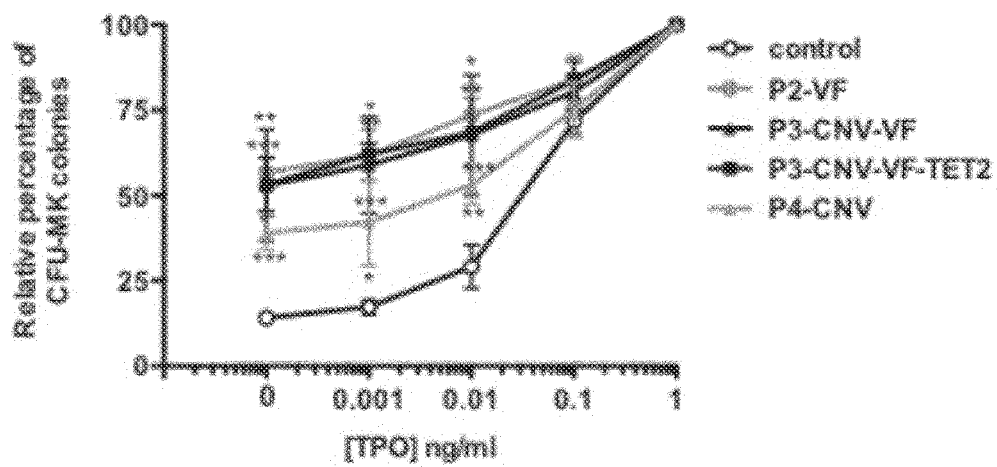
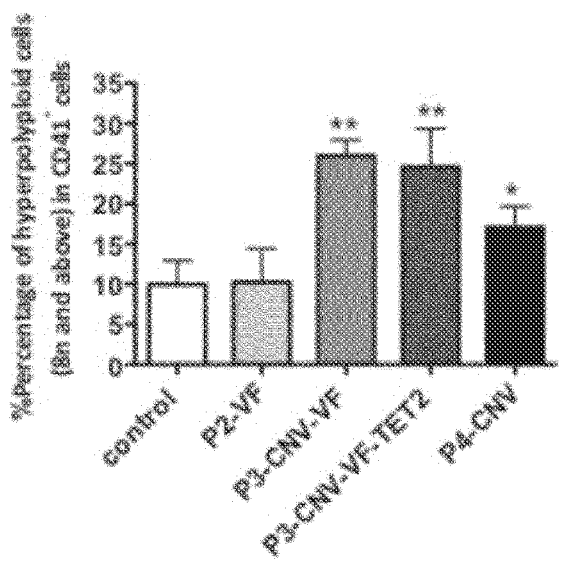
FIG. 5F

PROGNOSTIC MARKER FOR MYELOPROLIFERATIVE NEOPLASMS

The present inventors identified for the first time a germline genomic alteration that accounts for familial myeloproliferative neoplasms (MPN) and myeloid malignancies. More precisely, they identified a 700 kb germline duplication that predisposes patients to essential thrombocythemia (ET) with a high frequency of evolution to myelofibrosis (MF), secondary myelodysplastic syndromes (MDS) or acute myeloid leukemia (AML). Two out of the 6 duplicated genes (namely ATG2B and GSKIP) have been shown to be overexpressed in hematopoietic progenitors, and this overexpression cooperates with classical mutations in JAK2, MPL, and CALR to generate the MPN phenotype. The presence of the 700 kb germline duplication is thus of poor prognosis for a MPN patient. The present invention discloses a method for detecting a predisposition of developing a MPN, as well as a prognostic method for assessing the probability that an ET-suffering patient will develop a myelofibrosis, a secondary MDS or an AML. It also discloses a treating method for delaying MPN worsening, said treating method involving the inhibition of the ATG2B and GSKIP duplicated genes.

BACKGROUND OF THE INVENTION

Myeloproliferative neoplasms (MPNs) are clonal malignancies that are caused by genetic defects that occurs in the hematopoietic stem cell and which result in overproduction of one or several myeloid lineages. MPN are classified into three categories, chronic myloid leukemia (CML), classical MPN including polycythemia vera (PV), primary myelofibrosis (MF), or essential thrombocythemia (ET) and rare and unclassifiable MPN.

If most MPNs are sporadic diseases, familial cases of MPNs, for which the exact prevalence is unknown, have been reported. MPN familial cases have been described with family histories compatible with an autosomal dominant inheritance with incomplete penetrance. These familial case are very informative because germline mutations identified in same often phenocopy initiating mutations occurring in sporadic leukemias. Such germline mutations have been identified for example in RUNX1 (a familial platelet disorder which predisposes to AML or FPD/AML)[1], CEBPA[2], and GATA2[3,4] coding sequences as well as in the 5'UTR of ANKRD26 (THC2) gene[5]. In addition, genetic abnormalities observed in familial MPNs are similar to those identified in sporadic cases such as JAK2V617F and TET2 mutations.[6,7]

The independent acquisition of several oncogenic hits in the same MPN patient suggested that unidentified germline predisposition may be present in some sporadic patients.[6-8] For example, the JAK2 46/1 haplotype was shown to increase the risk of developing a JAK2V617F MPN,[9] whereas a germline intronic single nucleotide polymorphism in TERT gene is another susceptibility factor for MPN development.[10] These susceptibility alleles are diversely present in the general population and favor the development or evolution of MPN sporadic cases.[18,19]

However, these susceptibility alleles appeared to have limited roles in familial MPNs. Notably, recent data show that the $JAK2^{V617F}$ mutation is quite frequent in the general ageing population,[35-37] suggesting that $JAK2^{V617F}$ rarely induce MPN development, as demonstrated in mouse engrafted with a single $jak2^{V617F}$ hematopoietic cell.[38] Thus, it is thought that some oncogenetic events may occur earlier, i.e., before these mutations.

Linkage and segregation analyses indicate that genetic predisposition to MPN cannot be related to a common alteration and rather involves a number of susceptibility loci responsible for independent familial aggregations.

Unfortunately, familial cases of myeloproliferative neoplasms are rare and no common germline susceptibility loci have been so far identified as being responsible for these diseases. In particular, no major predisposing gene for familial MPNs has been so far identified.

Additional efforts are therefore needed to identify a reliable diagnostic marker that allows identifying genetic predisposition to MPNs. There also exists a need of identifying a reliable marker for prognosticating their progression into worse diseases (AML for example).

In this context, the present inventors herein describe a newly identified germline copy number variation (CNV) that predisposes to myeloid malignancies particularly MPNs, most frequently essential thrombocythemia (ET) with a high frequency of myelofibrosis (MF) or MDS or AML. More precisely, they demonstrate that the autosomal dominant transmission of a 700 kb duplication in four geographically-related families predisposes to a MPN progressing to acute leukemia. Two genes located within this 700 kb duplication region were found to be overexpressed and to enhance hematopoietic progenitor differentiation. These two genes were found to cooperate with acquired JAK2, MPL and CALR mutations during MPN development. Thus, this germline duplication increases the probability of MPN worsening.

By identifying this duplicated region, the inventors improve their understanding of the mechanisms of MPN as well as myeloid malignancies predisposition, which results either in the induction of a genetic instability (favoring the acquisition of oncogenic mutations) or corresponds to a fertile ground for selection of somatic mutations.

DETAILED DESCRIPTION OF THE INVENTION

The present inventors identified a 700 kb germline duplication that predisposes patients to myeloid malignancies including AML, CMML, atypical CML and also particularly ET with a high frequency of evolution to MF or secondary MDS or AML. This germline duplication is the first identified genomic alteration that accounts for familial MPN. More precisely, the presence of this 700 kb germline duplication is sufficient to increase the generation of hematopoietic progenitor cells and the overproduction of erythroblasts, megakaryocytes and monocytes. Moreover, it is associated with an increased sensitivity to thrombopoietin (TPO).

In addition, two out of the 6 duplicated genes, namely ATG2B and GSKIP, have been shown to be overexpressed in hematopoietic progenitors. The overexpression of these genes was found to cooperate with classical mutations in JAK2, MPL, and CALR to generate the MPN phenotype.

The establishment of induced pluripotent stem cells from CD34+-sorted progenitor cells (iPSC clones) showed that i) the duplicated region promotes the amplification of hematopoietic progenitors through increasing their sensitivity to TPO; ii) it induces an increase in the size and ploidy of mature $CD41^+$ megakarocytes, iii) it cooperates with $JAK2^{V617F}$ to increase the sensitivity of erythroid progenitors to EPO and promotes a constitutive activation of signaling pathways, and iv) it synergizes with TET2 mutation and JAK2$^{V617F}$ to promote erythroid cell proliferation and amplification. The hypersensitivity of hematopoietic precursors to EPO and TPO was furthermore confirmed in primary cells collected from patients.

In summary, the duplicated locus promotes the occurrence of severe MPN through overexpression of ATG2B and GSKIP genes that induces an increased fitness for cells bearing somatic mutations such as mutations in JAK2, MPL and CALR.

Based on these results, the present inventors propose to detect the presence of this duplicated region in the genome of patients, in order i) to diagnose a genetic predisposition to MPN or myeloid malignancy, ii) to prognose, in a patient suffering Essential Thrombocytopenia (ET), the worsening of the disease (rapid progression to MF or secondary MDS or AML). Finally, they propose to treat MPN patients carrying the duplicated region by impairing the surexpression of the ATG2B and GSKIP genes.

Definitions

In the present application, the term "MPN" stands for "myeloproliferative neoplasms". It encompasses any of the following disorders: chronic myelogenous leukemia (CML), polycythemia vera (PV), primary myelofibrosis (MF), or essential thrombocythemia (ET) or mastocytosis, hypereosinophilic syndrome, chronic neutrophilic leukemia or other rare/unclassified form. These diseases are characterized by an excess of bone marrow cells. The increased number of these cells may not cause any symptoms, but a number of medical problems or symptoms may occur. In particular, MPNs may evolve into myelodysplastic/myeloproferative syndrome (MDS/MPN) or myeloid tumours such as acute myeloid leukemia (AML).

Essential thrombocythemia (ET) is a myeloproliferative neoplasm (MPN) characterized by thrombocytosis with bone marrow megakaryocytic hyperplasia and a tendency to develop vascular complications, including thrombosis, microvascular disturbances, and hemorrhage. This disease affects an estimated 1 to 24 per 1 million people worldwide. The disease appears at all ages, with a median age of ~60 years, and shows a female predominance. Typical features of essential thrombocythemia are thrombotic and haemorrhagic complications, although most patients are asymptomatic. Transient ischaemic attacks, erythromelalgia and Budd-Chiari syndrome are complications which can occur in ET patients or can develop before the diagnosis of ET is apparent. Bleeding is usually associated with thrombocytosis exceeding 1500×10$^9$/L due to acquired von Willebrand disease. Other signs and symptoms of essential thrombocythemia include an enlarged spleen (splenomegaly); weakness; headaches; or a sensation in the skin of burning, tingling, or prickling. Some people with essential thrombocythemia have episodes of severe pain, redness, and swelling (erythromelalgia), which commonly occur in the hands and feet.

Myelodysplastic syndrome (MDS) corresponds to hematological conditions with ineffective production (or "dysplasia") of all blood cells. "Secondary MDS" occurs because of damage to the DNA from chemotherapy or radiation therapy previously given to treat another medical condition. MDS can develop two to 10 years after such treatment. These secondary MDS are for example MDS/MPN diseases that possess both dysplastic and proliferative features. This category is composed of myeloid disorders including chronic myelomonocytic leukemia (CMML), juvenile myelomonocytic leukemia (JMML), and atypical chronic myeloid leukemia without BCR-ABL transcript (aCML).

Myelofibrosis (MF), also known as osteomyelofibrosis, is a rare bone marrow cancer. It is currently classified as a myeloproliferative neoplasm (MPN), in which the proliferation of an abnormal clone of hematopoietic progenitor cells in the bone marrow and other sites results in fibrosis, or in the replacement of the marrow with collagenous connective tissue fibers. MF can occur on its own, called "primary myelofibrosis," or as a progression of other bone marrow diseases. Other MPNs that can progress to myelofibrosis include polycythemia vera (PV) and essential thrombocythemia (ET). In about 12 percent of patients with myelofibrosis, MF will transform to AML, a type of blood and bone marrow cancer that progress rapidly.

Acute myeloid leukemia (AML), also known as "acute myelogenous leukemia" or "acute nonlymphocytic leukemia" (ANLL), is a cancer of the myeloid line of blood cells, characterized by the expansion of undifferentiated cells called "blasts" blocked at different stages of differentiation in the bone marrow, that are then circulating into the blood. These diseases can be de novo or secondary malignancies. The latter could develop during a relapse after initial remission (due to chemotherapeutic treatments or as non complete eradication of initiating disease) or during the clinical course of a MPN or a MDS.

The methods of the invention involve at least the following steps:
a) obtaining a biological sample of said subject, and
b) analyzing the copy number of a genomic region having the SEQ ID NO:1, or a fragment thereof, in said biological sample or
c) analyzing the overexpression of the ATG2B or/and the GSKIP genes.

As used herein, the expression "biological sample" refers to any sample containing genomic DNA or mRNA from a subject. Said DNA may be contained in a solid tissue, in fluids and/or excretions of said subject. Said fluid is for example blood, serum, plasma, or urine. In a preferred embodiment, said biological sample is a blood sample of said subject, bone marrow or spleen or skin biopsies, or any other cells. Indeed, such a blood sample may be obtained by a completely harmless blood collection from the subject and thus allows for a non-invasive diagnosis. The blood sample used in the method of the invention is preferably depleted of most, if not all erythrocytes, by common red blood cell lysis procedures. The detection is performed on the remaining blood cells, which are white blood cells (e.g., neutrophils, monocytes, lymphocytes, basophiles, etc.) and platelets.

As used herein, the term "subject" refers to any mammal, preferably a human. Said subject may be a healthy individual. Yet, the method of the invention is particularly useful for testing a subject that is predisposed to developing a MPN. In that case, the method of the invention enables to confirm that said subject develops or is predisposed for developing a MPN. Said subject has for example a parent carrying the duplicated region highlighted by the present inventors. Alternatively, said subject may carry a susceptibility allele, such as the JAK2 46/1 haplotype, an intronic single nucleotide polymorphism in the TERT gene, or variants in ERCC2. ATM, CCDC6 and/or GRβ genes[10, 18, 19].

The method of the invention is also particularly useful for testing a subject that is thought to develop a MPN, an AML, a CMML, or a a CML. Said subject is for example exhibiting some of the MPN symptoms, such as an increase in the bone marrow cells in platelets, granulocytes or red cells. In that case, the method of the invention enables to confirm that said subject develops a MPN.

The term "copy number of a gemomic region" herein designates the number of different locations of said genomic region within the genomic DNA, either on same or different chromosomes. Accordingly, in the meaning of the invention, a genomic region has "two copy numbers" considering the 2 alleles. In other terms, the copy number of a genomic region is to be assessed on the entire genome. If, by chance, a genomic region is found duplicated on one allele of a chromosome, it will therefore be considered in the present application that the genome of the tested subject carries "three copy numbers" of said genomic region. In other words, a tested subject carries "three copy numbers" of a genomic region if on at least one of its allele, said genomic region is duplicated.

Preferably, in the methods of the invention, the analyzing step is performed on the two alleles of each chromosome, as the MPN development will be more rapid if each allele of the subject carries a duplicated copy of the genomic region of SEQ ID NO:1 or of its fragment.

As used herein, a chromosomic region is said to be "duplicated" if it can be detected on at least two different geographic locations on the same chromosome or on different chromosomes, i.e., if two copies of said region exist within the genome (more generally, it is herein said that a chromosomic region is "duplicated" if it can be found on three/four/five ( . . . ) different locations). Of course, the presence of said chromosomic region on both alleles of the same chromosome does not mean that the said region is duplicated. Therefore, a chromosomic region is said to be "duplicated" if it can be detected not only on two corresponding alleles, but also on (at least) one third location.

The genomic region of SEQ ID NO:1 is a 700×10³ pb region that is initially found on chromosome 14q32, more precisely on the position 14q32.13-q32.2, 1.86 Mb interval (95.76 Mb-97.62 Mb, hg19). This genomic region includes 5 whole genes (TCL1A, GSKIP, ATG2B, BDKRB1, and BDKRB2 genes), together with the first exon of the AK7 gene.

In a preferred embodiment, the analyzing step of the methods of the invention is performed on the whole genomic DNA of the subject. In a more preferred embodiment, it is performed on chromosome 14 or on any other chromosomes. It was established that the duplication is generally a 700 kb head-to-tail tandem duplication (FIG. 2C). Therefore, the analyzing step of the methods of the invention is preferably performed only on chromosome 14. More preferably, in this case, the CNV junction region of SEQ ID NO:14 is to be detected.

In view of the results presented below, the skilled person will easily understand that the MPN predisposition and rapid worsening is not necessarily due to the presence of the whole genomic region of SEQ ID NO:1. In fact, this genomic region contains important genes that are responsible of molecular mechanisms inducing hematopoietic cell proliferation. These genes are the TCL1A, GSKIP, ATG2B, BDKRB1, and BDKRB2 genes. Among these genes, two have been shown by the present inventors to be overexpressed in hematopoietic cells, where they promote proliferation and may therefore account for the rapid progression of ET to MF and/or AML, as observed in the tested families.

To perform the methods of the invention, it is therefore sufficient to detect the duplication of fragments of the genomic region of SEQ ID NO:1. Said fragment contains preferably at least 10, more preferably at least 20, even more preferably at least 30 consecutive nucleotides of SEQ ID NO:1. The term "fragment" also encompasses the juxtaposition of two or more fragments as defined above. Thus, the nucleic acid of sequence SEQ ID NO:14 (which contains the proximal and distal breakpoints of the CNV of SEQ ID NO:1) can be considered as a fragment of SEQ ID NO:1.

Preferably, said fragments contain either the GSKIP gene or the ATG2B gene or the TCL1A gene, or the BDKRB1 gene, or of the BDKRB2 gene or the AK7 gene.

Alternatively, these fragments may be non-encoding fragments, for example regions mapping the proximal or distal breakpoint of the CNV. In a preferred embodiment of the invention, the fragment to be analyzed in step b) of the invention contains the ATG2B gene. This fragment contains (or has) for example the nucleotide sequence SEQ ID NO:2.

In a preferred embodiment of the invention, the fragment to be analyzed in step b) of the invention contains the GSKIP gene. This fragment contains (or has) for example the nucleotide sequence SEQ ID NO:3.

In a preferred embodiment of the invention, the fragment to be analyzed in step b) of the invention contains the TCL1A gene. This fragment contains (or has) for example the nucleotide sequence SEQ ID NO:4.

In a preferred embodiment of the invention, the fragment to be analyzed in step b) of the invention contains the BDKRB1 gene. This fragment contains (or has) for example the nucleotide sequence SEQ ID NO:5.

In a preferred embodiment of the invention, the fragment to be analyzed in step b) of the invention contains the BDKRB2 gene. This fragment contains (or has) for example the nucleotide sequence SEQ ID NO:6.

In a preferred embodiment of the invention, the fragment to be analyzed in step b) of the invention contains the AK7 gene. This fragment contains (or has) for example the nucleotide sequence SEQ ID NO:7.

In another preferred embodiment of the invention, the fragment to be analyzed in step b) of the invention contains any combinations of the genes of SEQ ID NO:2 to 7. In particular, it may contain both the ATG2B gene and the GSKIP gene of SEQ ID NO:2 and 3, or all the genes of SEQ ID NO:2-7.

Moreover, it is possible to check that the SEQ ID NO:14 is found in said patient, establishing that the patient has a head-to-tail tandem 700 kb duplication (SEQ ID NO:14 contains the proximal and distal breakpoints of the CNV, as herein disclosed). It is also possible to check for the presence of any fragment of SEQ ID NO:14, said fragment containing preferably at least 10, more preferably at least 20, consecutive nucleotides of SEQ ID NO:14.

In a particular embodiment, the genomic region whose copy number is analyzed by the method of the invention is homologous to the genomic region of SEQ ID NO:1 to SEQ ID NO:7. By "homologous", it is herein meant that the sequences encodes the same proteins but, due to codon degeneracy, are not identical and have sequence similarity. The term "sequence similarity", in all its grammatical forms, refers to the degree of identity or correspondence between the said nucleic acid sequences. In a preferred embodiment, the homologous genomic region to be detected by the methods of the invention has a nucleotide sequence sharing at least 80% identity, preferably 90% identity, more preferably 95% identity with SEQ ID NO:1 to SEQ ID NO:7.

For the purpose of the present invention, the "percentage of identity" between two nucleic acid sequences is intended to refer to a percentage of nucleotides which are identical between the two sequences obtained after the best alignment. This percentage is purely statistical and the differences between the two sequences are distributed randomly and throughout their length. Sequence comparisons between two nucleic acid are traditionally carried out by comparing these sequences after having optimally aligned them, said comparison being carried out by segment or by "window of comparison" in order to identify and compare local regions of sequence similarity. The optimal alignment of the sequences for comparison can be produced, besides manually, by means of the global homology algorithm of Needleman and Wunsch (1970) [J. Mol. Biol. 48:443. The percentage of identity is calculated by determining the number of identical positions for which the nucleotide or the amino acid residue is identical between the two sequences, dividing this number of identical positions by the total number of positions and multiplying the result obtained by 100 so as to obtain the percentage of identity between these two sequences. For example, the needle program available on the site ebi.ac.uk, may be used, the parameters used being those given by default (in particular for the parameters "Gap open":10, and "gap extend":0.5; the matrix chosen being, for example, the "BLOSUM 62" matrix proposed by the program), the percentage of identity between the two sequences to be compared being calculated directly by the program.

Detecting copy number variations of a genomic region can be performed by any appropriate technology known in the art. For example, one can use cytogenetic techniques such as comparative genomic hybridization array, or virtual karyotyping with SNP microarrays. It is also possible to detect copy number variations by next-generation sequencing or by quantitative PCR and RT-PCR.

Characterizing the proximal and distal breakpoints of the duplicated region and junction sequence can be performed by PCR (primers are listed below).

In molecular biology and bioinformatics, a SNP array is a type of DNA microarray which is used to detect polymorphisms within a population. The basic principles of SNP array are the same as the DNA microarray. These are the convergence of DNA hybridization, fluorescence microscopy, and solid surface DNA capture. The three mandatory components of the SNP arrays are: i) the array that contains immobilized nucleic acid sequences or target; ii) one or more labeled Allele specific oligonucleotide (ASO) probes; and iii) a detection system that records and interprets the hybridization signal.

Comparative genomic hybridization (CGH) is a molecular cytogenetic method of screening a sample for genetic changes. The method is based on the hybridization of fluorescently target DNA (frequently fluorescein (FITC)) and normal DNA (frequently rhodamine or Texas Red) to normal human metaphase preparations. Using epifluorescence microscopy and quantitative image analysis, regional differences in the fluorescence ratio of gains/losses vs. control DNA can be detected and used for identifying abnormal regions in the genome. CGH will detect only unbalanced chromosomes changes, e.g., copy number variation.

In the method of the invention, the copy number variation is detected by analyzing the number of copies of the GSKIP and/or ATG2B genes and/or of the TCL1A gene, and/or of the BDKRB1 gene, and/or of the BDKRB2 gene or of the AK7 gene in said biological sample. A number of copies higher than or equal to three in the biological sample of a subject as compared to the normal expression level (two copies) is an indication that the patient may develop a myeloid neoplasm (MPN). The number of copies of a DNA region can be detected e.g., by SNP array, CGH array or qPCR.

In another embodiment, the copy number variation is detected by analyzing the expression of the GSKIP gene and/or of the ATG2B gene and/or of the TCL1A gene, and/or of the BDKRB1 gene, and/or of the BDKRB2 gene or of the AK7 gene in said biological sample. A significantly higher level of expression of said genes in the biological sample of a subject as compared to the normal expression level is an indication that the patient may develop a myeloid neoplasm (MPN).

As used herein, a "control" corresponds preferably to a control sample comprising cells from a healthy subject or from a subject that does not suffer from a MPN. More preferably, said control sample corresponds to peripheral blood leukocytes (PBL) of an healthy subject or granulocytes or platelets or any other kind of cells. The "normal" copy number of each gene or of SEQ ID NO:1 in said control samples is of two. The "normal" level of expression of said genes corresponds to the level of expression of said genes in said control sample. More preferably, said normal level of expression is the average expression level of said genes in several control samples.

In a preferred embodiment of the invention, the method of the invention requires the analysis of the expression of mRNA transcript or mRNA precursors of the GSKIP gene and/or of the ATG2B gene and/or of the TCL1A gene, and/or of the BDKRB1 gene, and/or of the BDKRB2 gene or of the AK7 gene.

Such analysis can be performed by preparing mRNA/cDNA from a biological sample from a subject, and hybridizing the mRNA/cDNA with a reference polynucleotide. The prepared mRNA/cDNA can be used in hybridization or amplification assays that include, but are not limited to, Southern or Northern analyses, polymerase chain reaction analyses, such as quantitative PCR (TAQMAN), and probes arrays such as GENECHIP™ DNA Arrays (AFFYMETRIX) or RNA-sequencing.

Advantageously, the analysis of the expression level of mRNA transcribed from the GSKIP gene or of the ATG2B gene involves the process of nucleic acid amplification, e.g., by RT-PCR, ligase chain reaction, self-sustained sequence replication, transcriptional amplification system, Q-Beta Replicase, rolling circle replication or any other nucleic acid amplification method, followed by the detection of the amplified molecules using techniques well known to those of skill in the art.

In another preferred embodiment, the copy number variation is detected by analyzing the expression level of the proteins translated from the GSKIP gene and/or of the ATG2B gene and/or of the TCL1A gene, and/or of the BDKRB1 gene, and/or of the BDKRB2 gene or of the AK7 gene.

Such analysis can be performed using an antibody (e.g., a radio-labeled, chromophore-labeled, fluorophore-labeled, or enzyme-labeled antibody), an antibody derivative (e.g., an antibody conjugate with a substrate or with the protein or ligand of a protein of a protein/ligand pair (e.g., biotin-streptavidin), or an antibody fragment (e.g., a single-chain antibody, an isolated antibody hypervariable domain, etc.) which recognize specifically the GSKIP protein (SEQ ID NO:9), the ATG2B protein (SEQ ID NO:8), the TCL1A protein (SEQ ID NO:10), the BDKRB1 protein (SEQ ID NO:11), the BDKRB2 (SEQ ID NO:12) or the AK7 protein (SEQ ID NO:13). Said analysis may involve a variety of techniques well known by one of skill in the art including (but not limited to) enzyme immunoassay (EIA), radioimmunoassay (RIA), Western blot analysis and enzyme linked immunoabsorbant assay (ELISA).

Polyclonal antibodies can be prepared by immunizing a suitable animal, such as mouse, rabbit or goat, with the targeted protein (e.g. of SEQ ID NO:4 or 5) or a fragment thereof (e.g., at least 10 or 15 amino acids). The antibody titer in the immunized animal can be monitored over time by standard techniques, such as with an ELISA using immobilized polypeptide. At an appropriate time after immunization, e.g., when the specific antibody titers are highest, antibody producing cells can be obtained from the animal and used to prepare monoclonal antibodies (mAb) by standard techniques, such as the hybridoma technique originally described by KOHLER and MILSTEIN (*Nature*, vol. 256, p:495-497, 1975), the human B cell hybridoma technique (KOZBOR et al, *Immunol*. vol. 4, p: 72, 1983), the EBV-hybridoma technique (COLE et al. *In Monoclonal Antibodies and Cancer Therapy*, Alan R. Liss, Inc, p: 77-96, 1985) or trioma techniques. The technology for producing hybridomas is well known (see generally Current Protocols in Immunology, COLIGAN et al. ed., John Wiley & Sons, New York, 1994). Hybridoma cells producing the desired monoclonal antibody can be detected by screening the hybridoma culture supernatants for antibodies that bind the polypeptide of interest, e.g., using a standard ELISA.

In the context of the present invention, an antibody is said to "recognize" or "bind" a peptide having a define sequence if said antibody has an affinity constant $K_a$ (which is the inverted dissociation constant, i.e. $1/K_d$) higher than $10^6$ $M^{-1}$, preferably higher than $10^7$ $M^{-1}$, more preferably higher than $10^9$ $M^{-1}$ for said peptide. Also, in the context of the present invention, an antibody is said to "specifically bind" or to "specifically recognize" a peptide if said antibody has an affinity constant $K_a$ higher than $10^6$ $M^{-1}$, preferably higher than $10^7$ $M^{-1}$, more preferably higher than $10^9$ $M^{-1}$ for said peptide and has an affinity constant $K_a$ lower than $10^4$ $M^{-1}$ for all the other peptide.

As used herein, "primers" designate isolated nucleic acid molecules that can specifically hybridize or anneal to 5' or 3' regions of a target genomic region (plus and minus strands, respectively, or vice-versa). In general, they are from about 10 to 30 nucleotides in length and anneal at both extremities of a region containing about 50 to 200 nucleotides in length. Under appropriate conditions and with appropriate reagents, such primers permit the amplification of a nucleic acid molecule comprising the nucleotide sequence flanked by the primers. As they have to be used by pairs, they are often referred to as "primers pair" or "primers set".

As used herein, "probes" are molecules that are capable of specifically hybridizing a genomic region of interest (e.g., of SEQ ID NO:1). They are useful to highlight the presence of said genomic region in biological samples. These probes may comprise at least one non-natural nucleotide, e.g., a peptide nucleic acid (PNA), a peptide nucleic acid having a phosphate group (PHONA), a bridged nucleic acid or locked nucleic acid (BNA or LNA), and a morpholino nucleic acid. Non-natural nucleotides also include chemically modified nucleic acids or nucleic acid analogs such as methylphosphonate-type DNA or RNA, phosphorothioate-type DNA or RNA, phosphoramidate-type DNA or RNA, and 2'-O-methyl-type DNA or RNA.

For certain uses, the probes and primers of the invention may be labeled—directly or indirectly—with a detectable label. Said label may be of any kind, depending on the experiment which is to be performed. Said label may be a radioactive isotope (such as $^{32}P$, $^{33}P$, $^{35}S$, $^3H$ or $^{125}I$, or a nonradioactive entity which is selected from ligands (such as biotin, avidin or streptavidin), dioxygenin, haptens, colorants and luminescent agents (such as radioluminescent, chemiluminescent, bioluminescent, fluorescent or phosphorescent agents). Preferably, 6-carboxyfluorescein (FAM) and tetramethylrhodamine (TAMRA) are used. Non-labeled polynucleotide sequences may also be used, directly, as a probe or primer, for example in PCR-based processes (e.g., in quantitative PCR).

"Specific hybridization" is observed when a define molecule does not hybridize with any other genomic region than its target genomic region. Preferably, it hybridizes with its target region in high stringency conditions, i.e., when the temperature and ionic strength conditions are chosen so as to allow the hybridization between two complementary DNA fragments. By way of illustration, high stringency conditions can be as follows. The DNA-DNA or DNA-RNA hybridization is carried out in two steps: (1) prehybridization at 42° C. for 3 hours in phosphate buffer (20 mM, pH 7.5) containing 5*SSC (1*SSC corresponds to a 0.15 M NaCl+ 0.015 M sodium citrate solution), 50% of formamide, 7% of sodium dodecyl sulfate (SDS), 10*Denhardt's, 5% of dextran sulfate and 1% of salmon sperm DNA; (2) actual hybridization for 20 hours at a temperature dependent on the size of the probe (i.e. 42° C. for a probe of size>100 nucleotides), followed by two 20-minute washes at 20° C. in 2*SSC+2% SDS and one 20-minute wash at 20° C. in 0.1*SSC+0.1% SDS. The final wash is carried out in 0.1*SSC+0.1% SDS for 30 minutes at 60° C. for a probe of size>100 nucleotides. The high stringency hybridization conditions described above for a polynucleotide of defined size will be adjusted by those skilled in the art for oligonucleotides of greater or smaller size, according to the teaching of Sambrook et al., 1989.

"Specific amplification" of a target region (e.g., of SEQ ID NO:1) is observed when primers specifically hybridizing the 5' or 3' regions surrounding said target region are used. Such a specific amplification may also be observed when primers specifically hybridizing within the genomic region of interest are used.

As used herein, the terms "in vitro" and "ex vive" are equivalent and refer to studies or experiments that are conducted using biological components (e.g., cells or population of cells) that have been isolated from their usual host organisms (e.g., animals or humans). Such isolated cells can be further purified, cultured or directly analyzed to assess the presence of the CNV. These experiments can be for example reduced to practice in laboratory materials such as tubes, flasks, wells, eppendorfs, etc. In contrast, the term "in vivo" refers to studies that are conducted on whole living organisms.

Within the scope of the present invention, by "nucleic acid" is meant mRNA, genomic DNA or cDNA derived from mRNA.

As used herein, the term "kit" refers to any system for delivering materials. In the context of reaction assays, it includes systems that allow the storage, transport, or delivery of reaction reagents (e.g., oligonucleotides, enzymes, etc. in the appropriate containers) and/or supporting materials (e.g., buffers, written instructions for performing the assay etc.) from one location to another. For example, kits include one or more enclosures (e.g., boxes) containing the relevant reaction reagents and/or supporting materials. As used herein, the term "fragmented kit" refers to delivery systems comprising two or more separate containers that each contains a subportion of the total kit components. The containers may be delivered to the intended recipient together or separately. For example, a first container may contain an enzyme for use in an assay, while a second container contains oligonucleotides. The term "fragmented kit" is intended to encompass kits containing Analyte specific reagents (ASR's) regulated under section 520(e) of the Federal Food, Drug, and Cosmetic Act, but are not limited thereto. Indeed, any delivery system comprising two or more separate containers that each contains a subportion of the total kit components are included in the term "fragmented kit." In contrast, a "combined kit" refers to a delivery system containing all of the components of a reaction assay in a single container (e.g., in a single box housing each of the desired components). The term "kit" includes both fragmented and combined kits.

In yet another aspect, the present invention relates to a pharmaceutical composition containing a pharmaceutically acceptable carrier.

The term "pharmaceutically acceptable carriers" refers to molecular entities and compositions that do not produce any adverse, allergic, or other untoward reaction when administered to an animal, or a human, as appropriate. Veterinary uses are equally included within the invention and "pharmaceutically acceptable" formulations include formulations for both clinical and/or veterinary use. As used herein, "pharmaceutically acceptable carrier" includes any and all solvents, dispersion media, coatings, anti-bacterial, and antifungal agents, isotonic and absorption delaying agents, and the like. The use of such media and agents for pharmaceutically active substances is well known in the art.

As used herein with respect to these methods, the term "administering" refers to various means of introducing a composition into a subject or a patient. It is intended to include (but is not limited to) subcutaneous injection, intravenous injection, intraocular injection, intracranial injection or implant, intradermal injection, intramuscular injection, intraperitoneal injection, intratracheal administration, epidural administration, inhalation, intranasal administration, oral administration, sublingual administration, buccal administration, rectal administration, vaginal administration, and topical administration.

As used herein, the term "effective amount" refers to an amount that will result in the desired result and may readily be determined by one of ordinary skill in the art. The compositions of the present invention may be formulated for various means of administration. These means are well known in the art and may include, for example, injection; tablets, pills, capsules, or other solids for oral administration; nasal solutions or sprays; aerosols, inhalants; topical formulations; liposomal forms; and the like.

Methods to Diagnose a Genetic Predisposition to MPN

Changes in CNVs, either by deletion or by amplification, have been frequently related to cancer predisposition.[20,21] The 700 kb germline duplicated region identified here, which segregates among the 24 affected family members of the four families, is associated with a high penetrance level, close to 70%. The predisposition locus is located in 14q32.2 region, which is rarely affected by recurrent cytogenetic aberrations in chronic and acute phases of MPN evolution,[22] although a trisomy 14 has been associated with myeloid malignancies that develop in older individuals.[23,24] Interestingly, one patient (F1,II-7) who directly developed an acute leukemia demonstrated a mosaic trisomy 14 with up to 5 copies of the CNV, arguing for a gene dosage effect.

The results of the inventors show that: i) the duplication of the 700 kb region favors the fitness of the mutations but does not directly induce a mutant phenotype and ii) the spectrum and distribution of signaling mutations in these families are similar to those of sporadic MPN cases. Thus, this duplication provides a favorable genetic background that facilitates the clonal dominance of a $JAK2^{V617F}$ cell.

In a first aspect, the present invention therefore relates to an in vitro method for Identifying a genetic predisposition to MPN development in a subject in need thereof, said method comprising the step of detecting the presence of the duplicated sequence of SEQ ID NO:1 or fragments thereof in the genome of said subject.

In a particular embodiment, said method comprises the following steps:
a) obtaining a biological sample of said subject,
b) analyzing the copy number of a genomic region having the SEQ ID NO:1, or a fragment thereof, in said biological sample,
wherein the detection of at least three copy numbers of said genomic region or of said fragment indicates that said subject develops or is predisposed to developing a MPN.

Said "biological sample", "subject", "copy number", and "fragment" are as defined above.

Said method may involve primers, probes and antibodies as defined above, and any of the above-mentioned technologies.

In a preferred embodiment, said biological sample is a blood sample.

In a preferred embodiment, said fragment contains either the GSKIP gene of SEQ ID NO:3 or the ATG2B gene of SEQ ID NO:2.

In another aspect, said method can be carried out by detecting the copy number of the nucleic acid sequence of SEQ ID NO:14.

Prognostic Methods of the Invention

As shown in the experimental part below, the duplicated locus of SEQ ID NO:1 promotes the occurrence of severe MPN through overexpression of ATG2B and GSKIP genes that induces an increased fitness for cells bearing somatic mutations such as mutations in JAK2, MPL and CALR.

Figure 8:
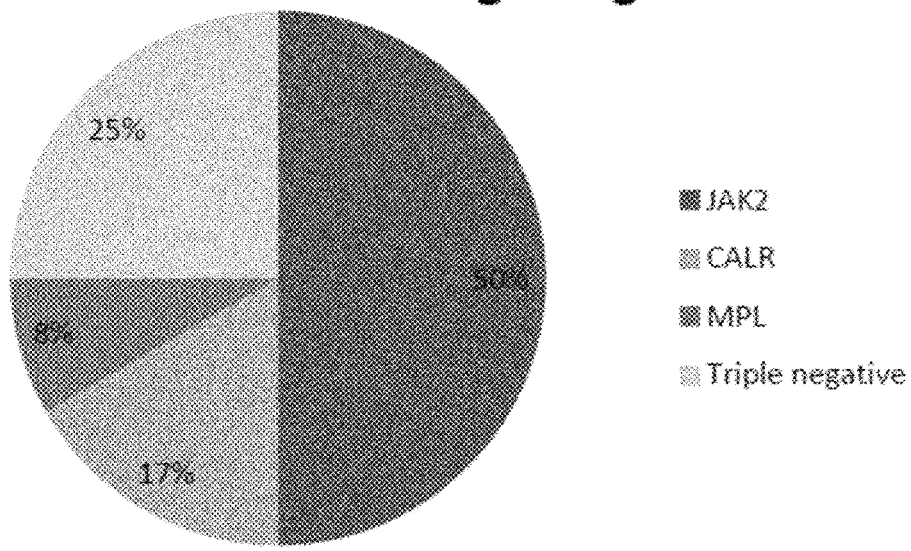
Figure 8:
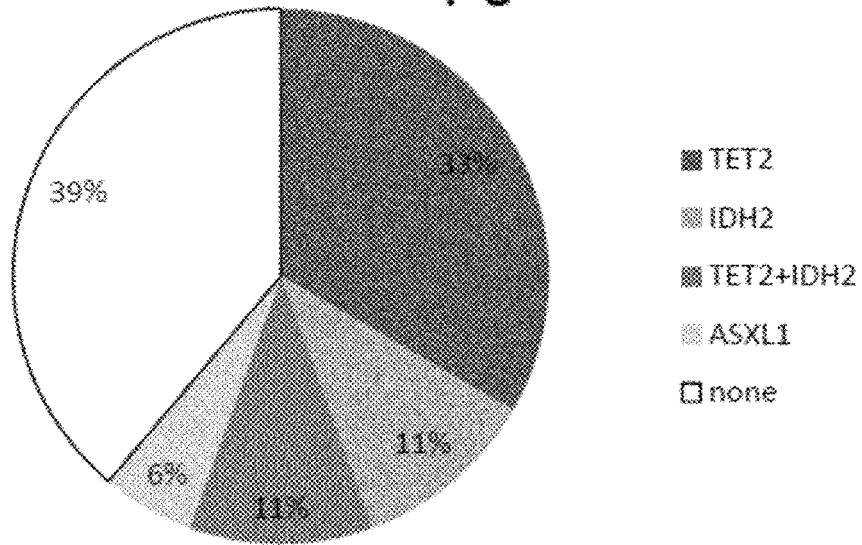

More precisely, their results unravel the acquisition, in ET suffering patients, of secondary events in TET2 (n=7/21, 38%), IDH1 (n=2/21, 10%), IDH2 (n=4/21, 19%) and ASXL1 (n=1/21, 5%) genes with disease evolution to myelofibrosis, MDS and leukemia (Table 1 and FIG. 8). Several patients exhibited biallelic mutation of TET2 or combination of epigenetic mutations (TET2/IDH1, TET2/IDH2, TET2/ASXL1 or IDH1/2; n=4/23, 17%).

Consequently, identification of the CNV of the invention may prognose, in a patient suffering Essential Thrombocytopenia (ET), the worsening of the disease (progression to MF or to secondary MDS or to AML).

In a second aspect, the present invention therefore relates to an in vitro method for proposing that a subject suffering from essential thrombocytopenia (ET) will develop a myelofibrosis (MF), a secondary or a de novo myelodysplastic syndrome (MDS) or acute myeloid leukemia (AML), said method comprising the step of detecting the presence of the duplicated sequence of SEQ ID NO:1, or fragments thereof, in the genome of said subject.

In a particular embodiment, said method comprises the following steps:
a) obtaining a biological sample from a subject suffering from ET,
b) analyzing the copy number of a genomic region having the SEQ ID NO:1, or a fragment thereof, in said biological sample,
wherein the detection of at least three copy numbers of said genomic region or of said fragment indicates that said subject will develop a MF, an AML or a MDS.

Said "biological sample", "subject", "copy number", "fragment", and diseases are as defined above.

Said method may involve primers, probes and antibodies as defined above, and any of the above-mentioned technologies.

In a preferred embodiment, said biological sample is a blood sample.

In a preferred embodiment, said fragment contains either the GSKIP gene of SEQ ID NO:3 or the ATG2B gene of SEQ ID NO:2.

In a preferred embodiment, said fragment contains both the GSKIP gene and the ATG2B gene. It has for example the SEQ ID NO:6.

The inventors observed that the more CNV detected, the quicker the disease worsened.

Therefore, the presence of three copy number of genomic region having the SEQ ID NO:1, or a fragment thereof, is preferably indicative that said ET subject develops or is predisposed to develop a myelofibrosis (MF).

Moreover, the presence of four copy number of genomic region having the SEQ ID NO:1, or a fragment thereof, is indicative that said ET subject develops or is predisposed to develop a secondary MDS or leukemia or a de novo AML.

Finally, the presence of five copy number of genomic region having the SEQ ID NO:1, or a fragment thereof, is indicative that said subject develops or is predisposed to develop a secondary MDS or leukemia or a de novo AML.

Primers and Probes

In a particular aspect, the present application relates to primers or probes that can be used in the above-cited methods so as to detect the copy number variation of SEQ ID NO:1, or of fragments thereof, specifically.

In this aspect, the present invention relates to primers that can specifically amplify the genomic region of SEQ ID NO:1, or fragments thereof, as defined above. These primers preferably contains 18 to 30 consecutive nucleotides of SEQ ID NO:1, or of its fragment. Preferably, they contain between 18 and 30 nucleotides (in total).

Examples of useful primers (that allow the amplification of fragments of SEQ ID NO:1) are of SEQ ID NO: 43-48. These sequences are given below.

```
ATG2B_ex36F
                                    SEQ ID NO: 43
GTCTCCTGGAGCTGATGTCAC

ATG2B_ex36R
                                    SEQ ID NO: 44
GCCATTAACCACTTCCACTGA

TCL1A_ex2F
                                    SEQ ID NO: 45
TACAGTTACGGGTGCTCTTGC

TCL1A_ex2R
                                    SEQ ID NO: 46
GGGTAGAGCTGCCACATGATA

HBB_F
                                    SEQ ID NO: 47
GTGCACCTGACTCCTGAGGAGA

HBB_R
                                    SEQ ID NO: 48
CCTTGATACCAACCTGCCCAG
```

More precisely, it is possible to amplify a fragment of SEQ ID NO:1 containing the exon 36 of ATG2B by using the primer set of SEQ ID NO:43-44, to amplify a fragment of SEQ ID NO:1 containing the exon 2 of TCL1A by using the primer set of SEQ ID NO:45-46.

Also, the present invention relates to probes that can specifically hybridize the genomic region of SEQ ID NO:1, or fragments thereof, as defined above. In a preferred embodiment, these probes comprise at least 15, preferably at least 20, more preferably at least 30 consecutive nucleotides of SEQ ID NO:1 or fragments thereof. In a more preferred embodiment, the molecules which can be used as a probe according to the present invention have a total minimum size of 15 nucleotides, preferably of 20 nucleotides. In an even more preferred embodiment, these molecules comprise between 15 and 40 nucleotides (in total).

The probes of the invention can be carried out in diverse ways. The most general method consists in immobilizing the nucleic acid molecules extracted from the biological sample on a support (such as nitrocellulose, nylon or polystyrene), and in incubating the immobilized target nucleic acid with the probe, under well-defined conditions. After hybridization, the excess probe is eliminated and the hybrid molecules formed are detected using the appropriate method (measurement of the radioactivity, of the fluorescence or of the enzymatic activity linked to the probe).

According to another embodiment, the probe of the invention can be used as a capture probe. In this case, the probe is immobilized on a support and is used to capture, by specific hybridization, the target nucleic acid obtained from the biological sample to be tested. The target nucleic acid is then detected using a second probe, termed "detection probe", which is labeled with an easily detectable element.

In another aspect, the present invention relates to primers that can specifically amplify the proximal breakpoint of the CNV region.

Examples of useful primers (that allow the amplification of proximal breakpoint through Q PCR) are of SEQ ID NO:17-28. These sequences are given below:

```
Chr14_B1-C1F
                                    SEQ ID NO: 17
ATGCTCTTGCAGCTACTCAGC

Chr14_B1-C1R
                                    SEQ ID NO: 18
CGGCAAAATCTCTCCTTCTCT

Chr14_B1-C2F
                                    SEQ ID NO: 19
TTCCTACCCACAGAAATGTGC

Chr14_B1-C2R
                                    SEQ ID NO: 20
AAGAAGGCAGCTAAGGGACTG

Chr14_B1-C2.1F
                                    SEQ ID NO: 21
GAGTCACACTTTGGGATCTGC

Chr14_B1-C2.1R
                                    SEQ ID NO: 22
TAACAGTTGGGGCAGAACAAG

Chr1.4 B1-C2.2F
                                    SEQ ID NO: 23
CCCACCCAAACTAATCTGTGA

Chr14_B1-C2.2R
                                    SEQ ID NO: 24
TAGGACGCAGACACACACAAG

Chr14_B1-C2.3F
                                    SEQ ID NO: 25
GGAAATTGCAGTGAGGTGAGA

Chr14_B1-C2.3R
                                    SEQ ID NO: 26
AGAAGGTCTGAATTGCACCTG
```

```
Chr14_B1-3F
                                        SEQ ID NO: 27
CTTTCCTGGTCACATTTTCCA

Chr14_B1-C3R
                                        SEQ ID NO: 28
TTAGCATTTTCAGCTGGGCTA
```

More precisely, it is possible to detect the proximal breakpoint through Q-PCR by using the primer sets of SEQ ID NO:17-18, SEQ ID NO:19-20, SEQ ID NO:21-22, SEQ ID NO:23-24, SEQ ID NO:25-26, or of SEQ ID NO:27-28.

In another aspect, the present invention relates to primers that can specifically amplify the distal breakpoint of the CNV region.

Examples of useful primers (that allow to amplify the distal breakpoint through Q-PCR) are of SEQ ID NO:29-40, whose sequence is given below:

```
Chr14_B2-C1F
                                        SEQ ID NO: 29
CACCAATCCTTGCTGAGTTGT

Chr14_B2-C1R
                                        SEQ ID NO: 30
CATTAGTAGCAGCCGAACCTG

Chr14_B2-C2F
                                        SEQ ID NO: 31
GGACTTGCCCAAGATCACATA

Chr14_B2-C2R
                                        SEQ ID NO: 32
TTAGCTGCCTGCTTCAAAATC

Chr14_B2-C2.1F
                                        SEQ ID NO: 33
AAGGACACCAGTTGTTGGATG

Chr14_B2-C2.1R
                                        SEQ ID NO: 34
GAACCTGTGAATGTGGCCTTA

Chr14_B2-C2.2F
                                        SEQ ID NO: 35
GCCAGGAGTTTGGTTTATCCT

Chr14_B2-C2.2R
                                        SEQ ID NO: 36
TGCCCAGCCTGTATCTGTATC

Chr14_B2-C2.3F
                                        SEQ ID NO: 37
AGGCAGAGGATGAAGAAGAGG

Chr14_B2-C2.3R
                                        SEQ ID NO: 38
CAGGTGACCCTTGAACAACAC

Chr14_B2-C3F
                                        SEQ ID NO: 39
AGGCAACATAGCAAGACCACA

Chr14_B2-C3R
                                        SEQ ID NO: 40
AGGAACTCAGGGTCAGAGAGC
```

More precisely, it is possible to detect the distal breakpoint through Q-PCR by using the primer sets of SEQ ID NO:29-30, SEQ ID NO:31-32, SEQ ID NO:33-34, SEQ ID NO:35-36, SEQ ID NO:37-38, or of SEQ ID NO:39-40.

In another aspect, the present invention relates to primers that can specifically amplify the junction between the two duplicated regions (SEQ ID NO:14).

Examples of useful primers (that allow the sequencing of said junction) are given below:

```
Chr14dup_joncF*
                                        SEQ ID NO: 41
TGGGCGTGGTGTAATACTAGC Chr14dup_joncR**
                                        SEQ ID NO: 42
TGGCCGTTCTGTTTATTGTTC
```

More precisely, it is possible to amplify or to sequence the junction region between the two duplicated region by using the primer set of SEQ ID NO:41 and 26 or the primer set of SEQ ID NO:42 and 33.

In another aspect, the present invention also relates to the use of these probes or primers for analyzing, detecting, identifying, or assaying the copy number of a genomic region having the SEQ ID NO:1, or of fragments thereof.

Specifically, these probes or primers may be used so as to:
identify a genetic predisposition to MPN in a subject in need thereof, and/or
prognose that a subject suffering from essential thrombocythemia will develop a myelofibrosis, a secondary myelodysplastic syndrome or an acute myeloid leukemia.
according to any of the above-described methods.

Treating Methods of the Invention

Of the 6 duplicated genes in the CNV region, the expression of only ATG2B and GSKIP was reproducibly detected in hematopoietic cells, including CD34+, MK and erythroid cells. TCL1A gene, whose overexpression has been first described in mature T cell leukemia, was not expressed in CD34+ cells and in myeloid cells, nor it was overexpressed in patient-derived EBVC. Strikingly, ATG2B cooperated with GSKIP to induce the spontaneous growth of CFU-MK either in patient cells or in iPSC-derived hematopoietic cells and ATG2B and GSKIP silencing reversed the phenotype. Loss-of function mutations in ATG2B, which encodes an important player in autophagy,[39] have been identified in gastric and colorectal cancers[40] whereas deregulated autophagy could affect HSC self-renewal capabilities, e.g. in ageing subjects.[41,42] The GSKIP gene encodes a negative regulator of GSK3beta,[43,44] thus mimicking an activation of the WNT/β catenin signaling pathway involved in HSC homeostasis and normal megakaryopoiesis,[45,46] as well as in the transformation of chronic myeloid leukemia.[47]

Accordingly, the overexpression of these 2 genes may account for the rapid progression of ET to MF and AML observed in these families, and it may be possible to impair this dramatic progression by limiting this overexpression.

The present inventors tested two human shRNA inhibiting the expression of these genes in hematopoietic cells. The sequences of these human shRNAs were:

```
For ATG2B:
                                        (SEQ ID NO: 15)
5'ATGCAATACTGTCACTATAAACTCGAGTTTATAGTGACAGTATTG
CA3'

For GSKIP:
                                        (SEQ ID NO: 16)
5'GGACAAACTTTGTAGTAATTACTCGAGTAATTACTACAAAGTTTG
TCC3'
```

Their transduction, alone or in combination, induced about 40-50%. reduction in the transcripts of their respective targets (FIG. 7a). Their effect was observed on MK progenitors and it was found a significant decrease in the frequencies of CFUMK with each shRNA or used in combination. In addition, the simultaneous silencing of both ATG2B and GSKIP led to a further decrease in CFU-MK size (FIGS. 7b and c). Moreover, their combination induced a major inhibition of TPO-independent CFU-MK growth (FIG. 7e).

In a further aspect, the present invention therefore proposes to use these compounds, or more generally any compound inhibiting the expression of the ATG2B and/or GSKIP genes or the activity of the ATG2B and/or GSKIP proteins for impairing the worsening of a MPN disease and/or improving the prognosis of a MPN or MDS suffering patient.

Inhibiting the ATG2B and/or GSKIP protein activity can be achieved for example with a receptor decoy, an aptamer, an antibody and/or a small molecule antagonist. ATG2B activity can be monitored by studying the autophagic behaviour of the treated cells. GSKIP activity can be monitored by studying GSK3beta and WNT signaling in the treated cells.

Inhibiting the expression of the ATG2B and/or GSKIP genes can be achieved by means of an anti-sense nucleic acid. A person skilled in the art would be able to design, make and use suitable anti-sense molecules, based on the sequences of the target genes, without undue experimentation. The anti-sense nucleic acid may be, e.g., an oligonucleotide, or a nucleic acid comprising an anti-sense sequence that is operably linked to an expression control sequence. The use of anti-sense nucleic acids to down-regulate the expression of a particular protein in a cell is well known in the art. An anti-sense nucleic acid molecule may comprise a nucleotide sequence that is complementary to the coding strand of another nucleic acid molecule (e.g., an mRNA sequence), or to a portion thereof, and accordingly is capable of hydrogen bonding to the coding strand of the other nucleic acid molecule. Alternatively, anti-sense sequences can be complementary to a sequence found in the 5' or 3' untranslated region of the mRNA or a region bridging the coding region and an untranslated region (e.g., at the junction of the 5' untranslated region and the coding region). The anti-sense nucleic acid can be complementary in sequence to a regulatory region of the gene encoding the mRNA, for instance a transcription initiation sequence or regulatory element, or a splice site. In one embodiment, an anti-sense nucleic acid is designed so as to be complementary to a region preceding or spanning the initiation codon on the coding strand or in the 3' untranslated region of an mRNA.

The anti-sense nucleic acid of the invention is preferably an RNA, such as a short interfering RNA (siRNA), a double-stranded RNA (dsRNA), a micro-RNA (miRNA),or a short-hairpin RNA (shRNA).

In one particular embodiment, the anti-sense nucleic acids of the invention are selected for their capability of reducing and even specifically blocking the expression of their target genes. For example, these anti-sense nucleic acids allow a reduction of more than 80%, 90%, 95% or 99% of the expression of their target genes.

Numerous programmes are available for the design of the anti-sense nucleic acids of the invention:

"siSearch Program" at: http://sonnhammer.cgb.ki.se/siSearch/siSearch_1.6.html
"SiDirect" at: http://design.rnai.jp/sidirect/index.php
http://www.ambion.com/techlib/misc/siRNA_tools.html
http://jura.wi.mit.edu/pubint/http://iona.wi.mit.edu/siRNAext/

In a preferred embodiment, the anti-sense nucleic acid of the invention is a short-hairpin RNA, for example of SEQ ID NO:15 or SEQ ID NO:16.

In a particular embodiment, the present invention relates to an anti-sense nucleic acid inhibiting at least 50%, 90%, 95% or preferably at least 99% of the expression of the ATG2B gene of SEQ ID NO:2 or of the expression of the GSKIP gene of SEQ ID NO:3, for use for impairing or preventing the worsening of a MPN disease (progression to myelofibrosis, MDS or AML) and/or for improving the prognosis of a MPN suffering patient (e.g., for enhancing its survival time).

In other terms, the present invention relates to a method for impairing or preventing the worsening of a MPN disease and/or for improving the prognosis of a MPN suffering patient, said method comprising the step of administering to said patient an effective amount of an anti-sense nucleic acid inhibiting at least 50%, 90%, 95% or 99% of the expression of the ATG2B gene of SEQ ID NO:2 or of the GSKIP gene of SEQ ID NO:3.

The present invention finally relates to a pharmaceutic composition comprising an effective amount of an anti-sense nucleic acid inhibiting at least 50/6, 90%, 95% or preferably at least 99% of the expression of the ATG2B gene of SEQ ID NO:2 or of the GSKIP gene of SEQ ID NO:3, as well as a pharmaceutically acceptable carrier, said carrier being as defined above.

Preferably, said anti-sense nucleic acid has the nucleotide sequence SEQ ID NO:15 or SEQ ID NO:16.

In another embodiment, deregulation of ATG2B and/or GSKIP genes, or duplication of ATG2B and/or GSKIP genes, can be determined to evaluate graft donors, in order to detect subject susceptible to be develop hematological malignancies, such as MPN, ET, MF, an AML or a secondary MDS. Indeed, graft donors presenting deregulation of ATG2B and/or GSKIP genes, or duplication of ATG2B and/or GSKIP genes would not be selected considering the risk of the graft to develop said hematological malignancies (AML and CMML).

Kits of the Invention

In another aspect, the present invention refers to a kit comprising at least one primer, one probe or one antibody as defined above.

In a preferred embodiment, the kit of the invention contains at least two primers amplifying specifically nucleic acids having the sequence SEQ ID NO:1 to 7, and/or at least one probe hybridizing specifically a nucleic acid having the sequence SEQ ID NO:1 to 7.

In another preferred embodiment, the kit of the invention contains at least two primers amplifying specifically nucleic acids having the sequence SEQ ID NO:14, and/or at least one probe hybridizing specifically a nucleic acid having the sequence SEQ ID NO:14.

In a preferred embodiment, the kit of the invention contains at least two sets of primers amplifying specifically nucleic acids having the sequence SEQ ID NO:2, SEQ ID NO:4 and/or SEQ ID NO:14 and/or at least two probes hybridizing specifically the nucleic acids having the sequence SEQ ID NO:2, SEQ ID NO:4 and/or SEQ ID NO:14.

Preferably, said primers/probes have the sequence mentioned above (SEQ ID NO:17-48).

In another embodiment, the kit of the invention contains polyclonal or monoclonal antibodies which recognize specifically the GSKIP protein (SEQ ID NO:9) and/or the ATG2B protein (SEQ ID NO:8).

In a more preferred embodiment, the kit of the invention comprises:

one set of primers amplifying specifically nucleic acids having the sequence SEQ ID NO:14, one probe hybridizing specifically the nucleic acids having the sequence SEQ ID NO:14, at least two sets of primers amplifying specifically nucleic acids having the sequence SEQ ID NO:2 and SEQ ID NO:4 respectively, at least two probes hybridizing specifically the nucleic acids having the sequence SEQ ID NO:2 and SEQ ID NO:4 respectively, at least two polyclonal or monoclonal antibodies which recognize specifically the GSKIP protein (SEQ ID NO:9) and the ATG2B protein (SEQ ID NO:8) respectively, or any combination of said primers, probes and antibodies.

The present kit can also include one or more reagents, buffers, hybridization media, nucleic acids, primers, nucleotides, probes, molecular weight markers, enzymes, solid supports, databases, computer programs for calculating dispensation orders and/or disposable lab equipment, such as multi-well plates, in order to readily facilitate implementation of the present methods. Enzymes that can be included in the present kits include nucleotide polymerases and the like. Solid supports can include beads and the like whereas molecular weight markers can include conjugatable markers, for example biotin and streptavidin or the like.

In one embodiment, the present kit also contains instructions for carrying out the methods of the invention. The instructions can be provided in any intelligible form through a tangible medium, such as printed on paper, computer readable media, or the like.

Still a further aspect of the present invention refers to the use of the abovementioned kit for:

identifying a genetic predisposition to MPN in a subject in need thereof, and/or prognosing that a subject suffering from essential thrombocythemia will develop a myelofibrosis, a secondary myelodysplastic syndrome or an acute myeloid leukemia.

FIGURE LEGENDS

Figure 1:
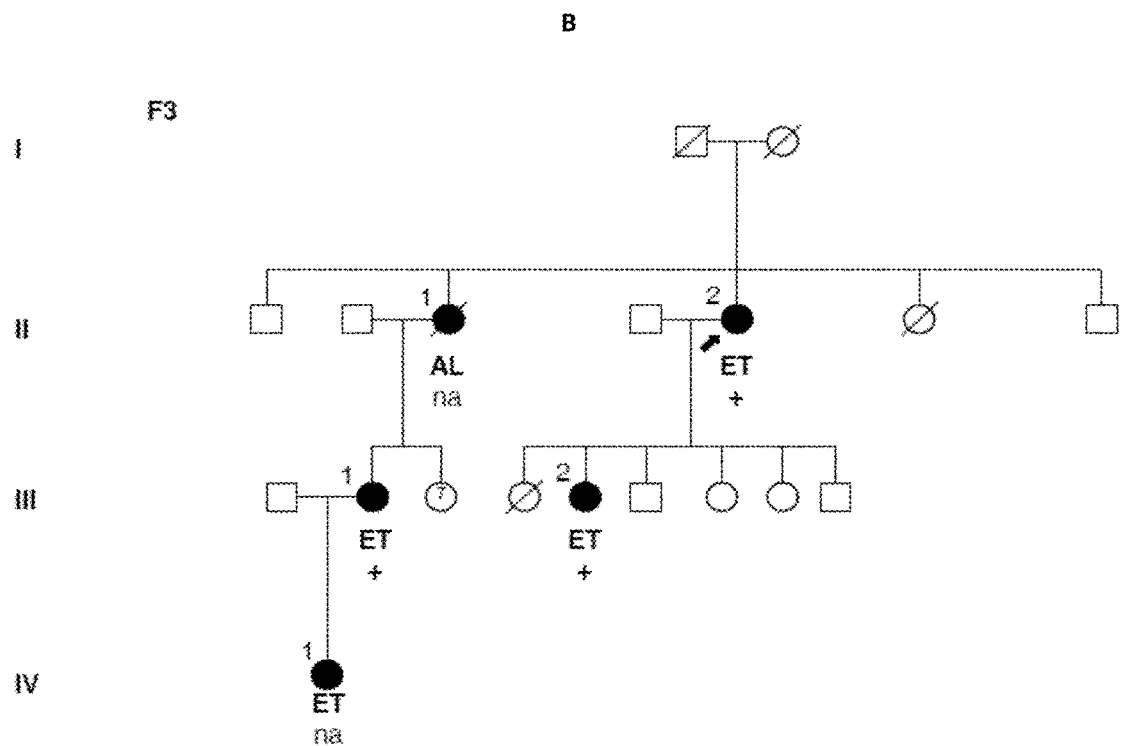
Figure 1:
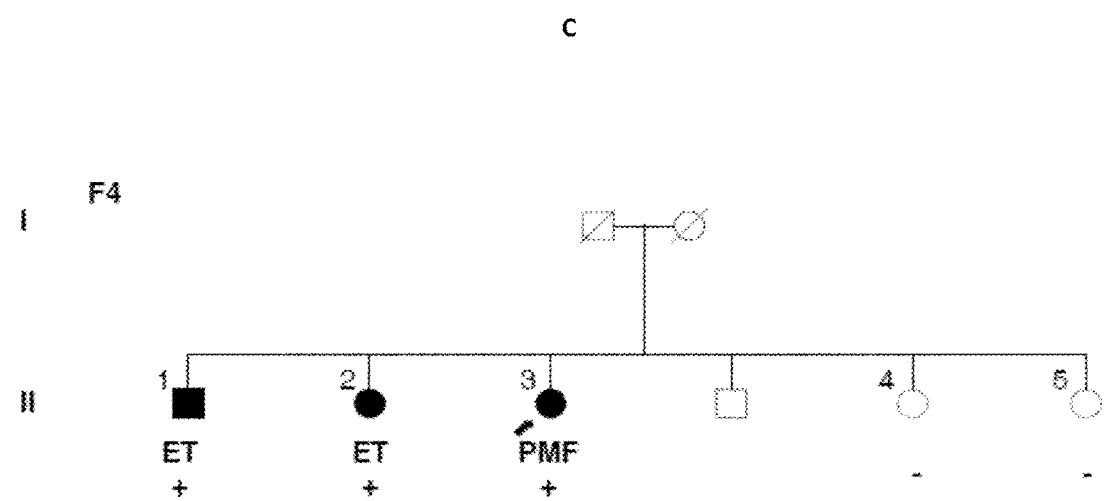
Figure 1D:
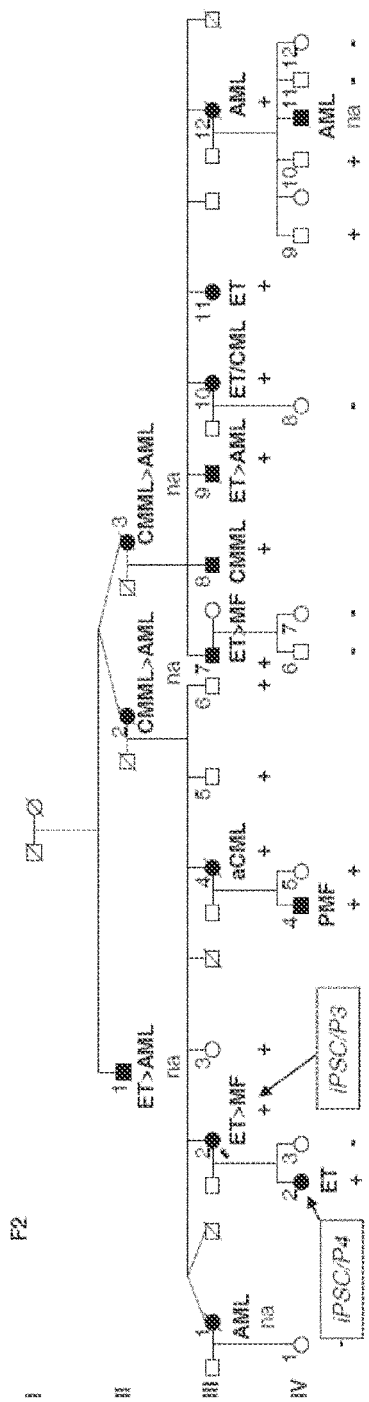

FIG. 1: Pedigrees of the four MPN families (A=family F1, B=family F3, C=Family F4, D=family F2). Filled symbols represent patients. Under each symbol, the first line indicates the phenotype at the time of diagnosis followed by the evolution; the second line is the genetic status for the germline CNV (+ when the CNV was found, − otherwise). "na" indicates not available.

Figure 2A:
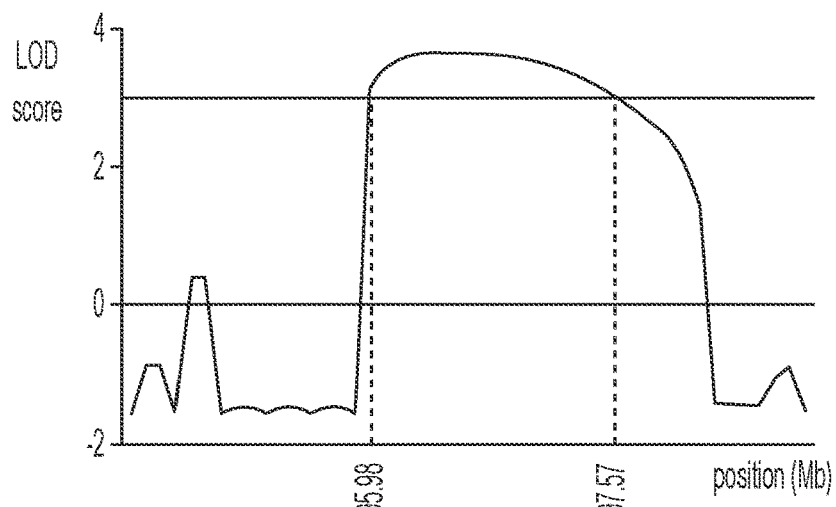
Figure 2B:
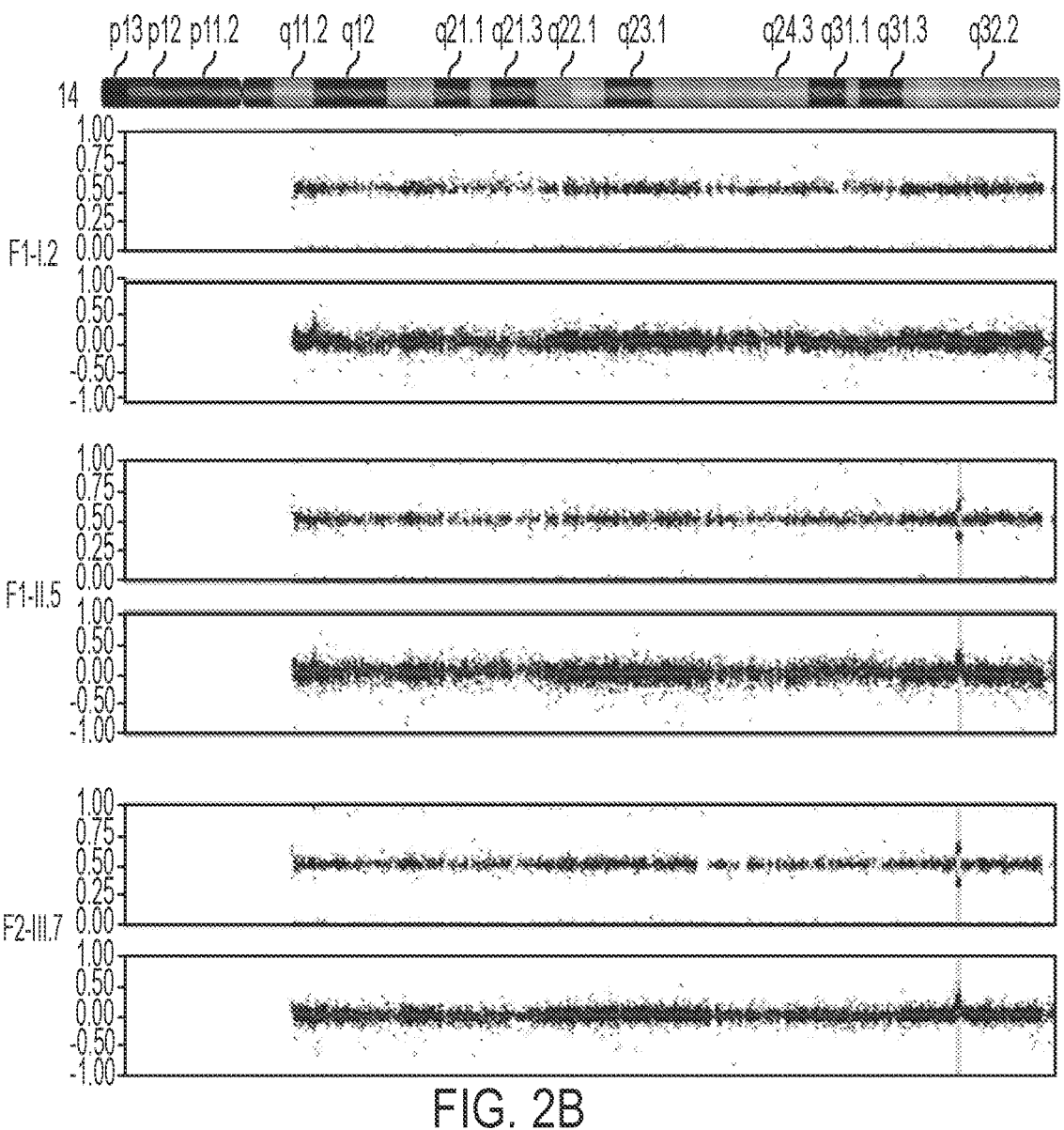
Figure 2:
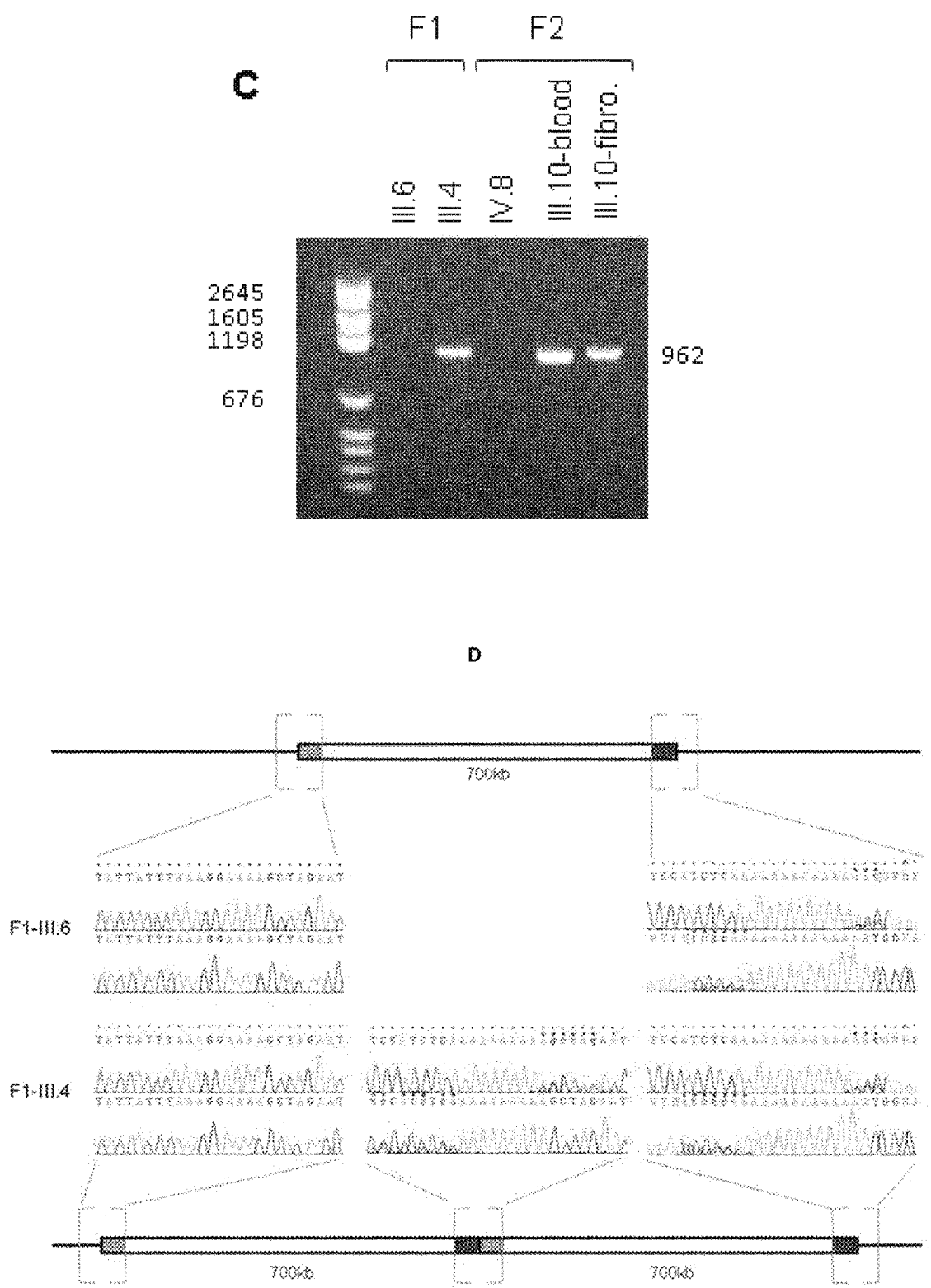

FIG. 2: Characterization of the germline CNV. (a) Positive linkage signal (Zscore=3.7) in 14q32. (b) SNP-array analysis revealing a 700 kb duplication in both families. For each individual, the lower plot shows the log R ratio (Y-axis) for 9592 probes (X-axis) of chromosome 14 and the upper plot shows the B allele frequency (Y-axis) for each probe position (X-axis). F1-II.5 and F2-III.7 array profiles demonstrate 3 copies at the genomic position chr14: 95.76 Mb-97.62 Mb, with an increased log R ratio of ~0.4 and B allele frequencies with values at 0 for AAA genotype, 0.33 for AAB genotype, 0.67 for ABB genotype and 1 for BBB genotype. F11-I.2 (control) array profile shows only two copies for this segment with a normal log R ratio and B allele frequencies with values at 0 for AA genotype, 0.5 for AB genotype and 1 for BB genotype. (c) Gel electrophoresis showing the amplification of a 962 bp junction fragment in patients (F1, III-4 and F2, III-10) and its absence in non-carrier controls (F1, III-6 and F2, IV-8). Analysis of DNA extracted from blood and fibroblasts (F2, III-10) showed the germline status of the identified CNV. Primers used for the PCR were Chr14_B2-C2.1F and Chr14_BI-C2.3R (as disclosed above). (d) Mapping and sequencing of the proximal and distal breakpoints established the duplication as a 700 kb head-to-tail tandem duplication. (e) Schematic structural organization of the duplicated region including six genes. Arrowheads indicate the transcription direction.

Figure 3:
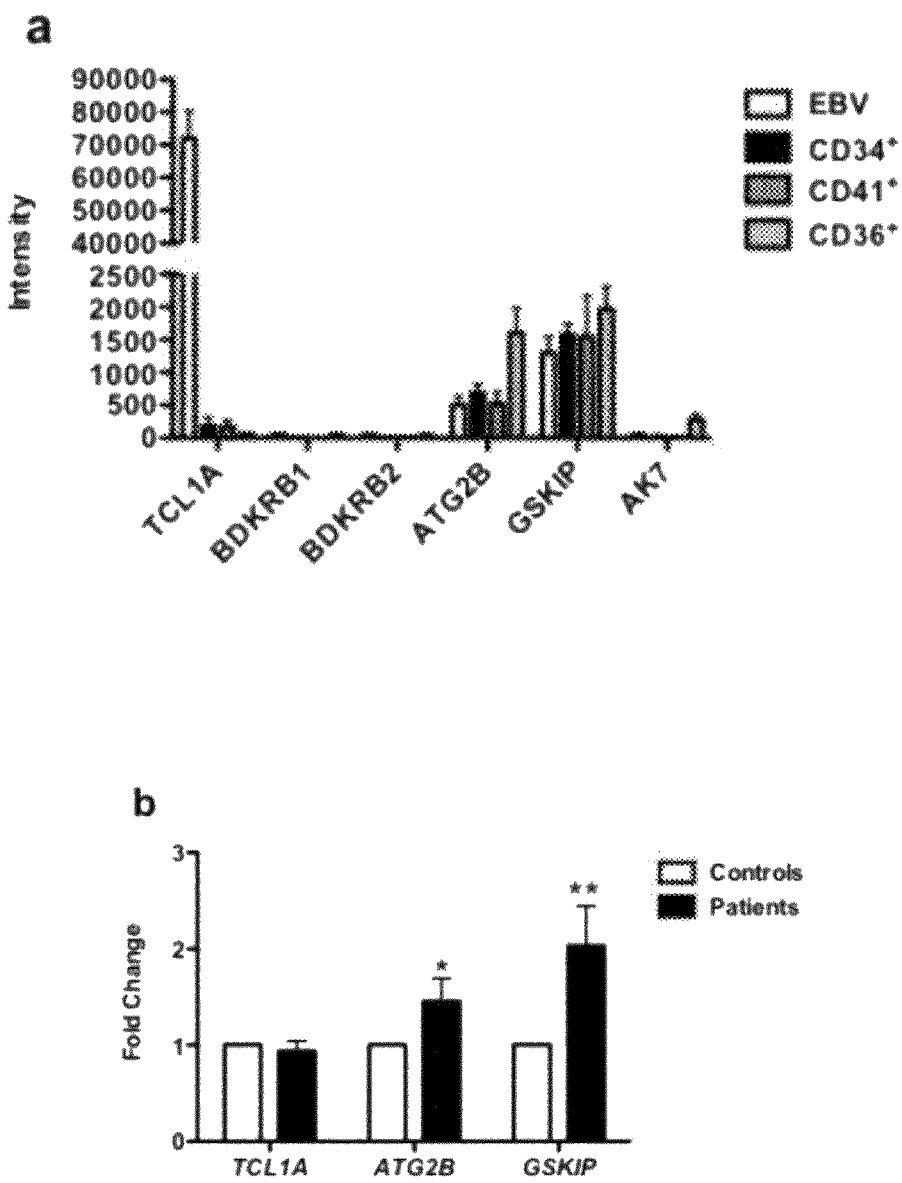
Figure 3:
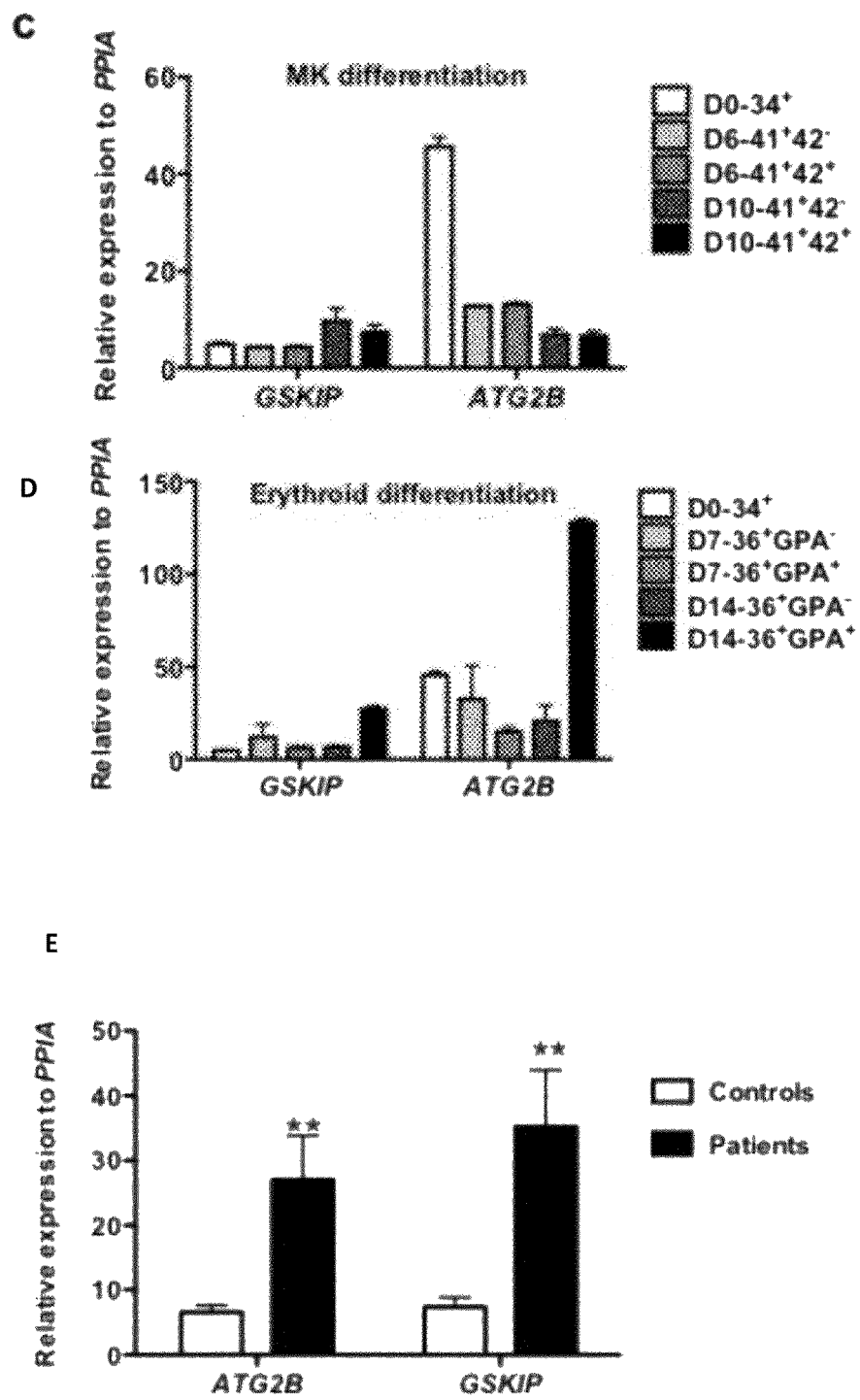

FIG. 3: ATG2B and GSKIP are overexpressed by the CNV. (a) TCL1A, BDKRB1, BDKRB2, ATG2B, GSKIP and AK7 intensities from microarrays in $CD34^+$ progenitors (n=3), $CD41^+$ megakaryocytes (n=3), $CD36^+$ erythroblasts (n=3) and EBV cell lines (n=3). (b) Relative fold change of TCL1A, ATG2B and GSKIP expressions in control EBV cell lines (n=3 in triplicate) compared to patients (n=5 in triplicate). (c/d) Primary $CD34^+$ cells from three control donors were sorted on $CD34^+$ and grown with (c) SCF (25 ng/mL) and TPO (20 ng/mL) or (d) SCF (25 ng/mL), IL-3 (10 μg/mL) and EPO (1 U/mL) and were sorted (c) at day 6 or 10 during megakaryocytic differentiation or (d) at day 7 or 14 for erythroid differentiation. ATG2B and GSKIP were quantified by qRT-PCR in each fraction. Relative expression to PPIA was calculated. (e) ATG2B and GSKIP expressions were quantified by qRT-PCR in $CD41^+CD42^+$ in 3 controls and 3 patients at day 10 (mean±SEM, n=3; *$P<0.05$, **$P<0.01$, by student t-test).

Figure 4:
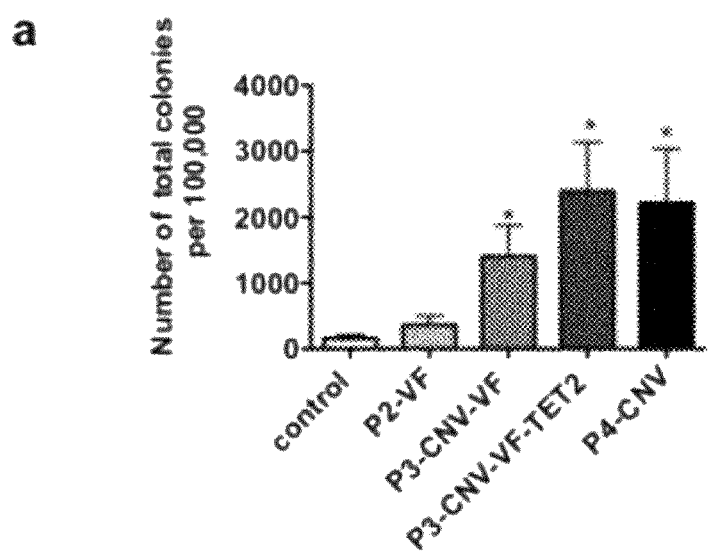

FIG. 4: Hematopotetic differentiation of iPSC: (a) iPSC were induced for hematopoietic differentiation on OP9 stromal cells. $1\times10^5$ cells were plated in semi-solid conditions (both methylcellulose and plasma clots) and hematopoietic progenitors were counted in both conditions at day 12 and 10, respectively (mean±SEM, n=4; *$P<0.05$). (b) Hematopoietic differentiation of iPSC (control, P2-VF, P3-CNV-VF, P3-CNV-VF-TET2, P4-CNV) was induced by seeding iPSC on OP9 stromal cells in the presence of VEGF and hematopoietic cytokines. Bulk and hematopoietic cells collected at day 11, 13, 15 and 18 were analyzed by flow cytometry. The relative percentage of $CD41^+$, $GPA^+$ or $CD14^+$ was calculated (mean±SEM, n=3; *$P<0.05$, $P<0.01$, *$P<0.001$ by student t-test for $CD41^+$ or $CD14^+$ and Bonferronni test for $GPA^+$). (c) Hematopoietic potential of iPSC was quantified by plating one TRA-1-81$^+$ cell per well in a 96-well plate coated with OP9 stromal cells. The absolute number of $CD41^+$, $GPA^+$ and $CD14^+$ cells in each clone was measured by flow cytometry at day 18 (mean±SEM, n>20; 2 independent experiments; Mann Whitney test, two-tailed, *$P<0.05$, ***$P<0.001$).

Figure 5:
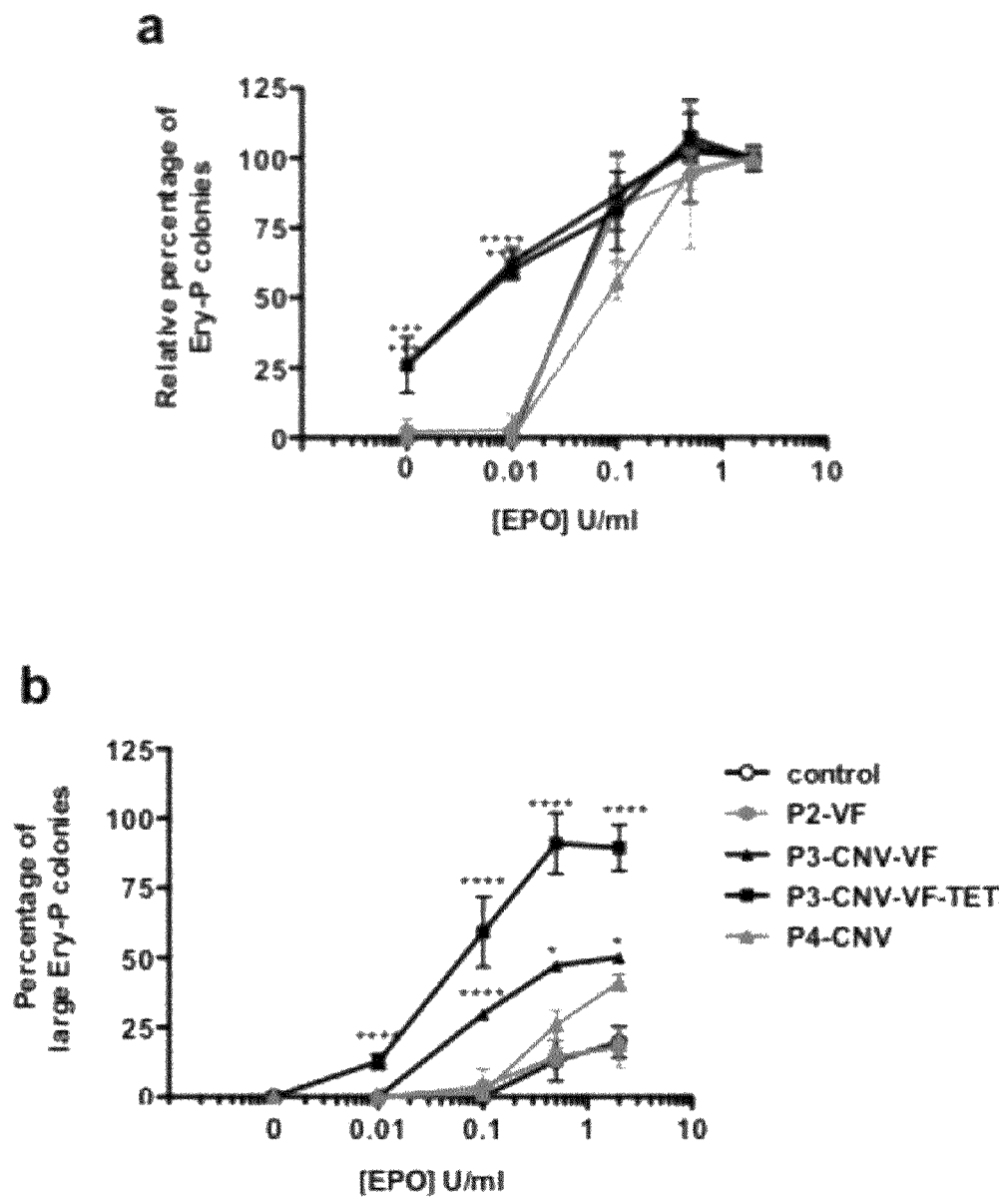
Figure 5:
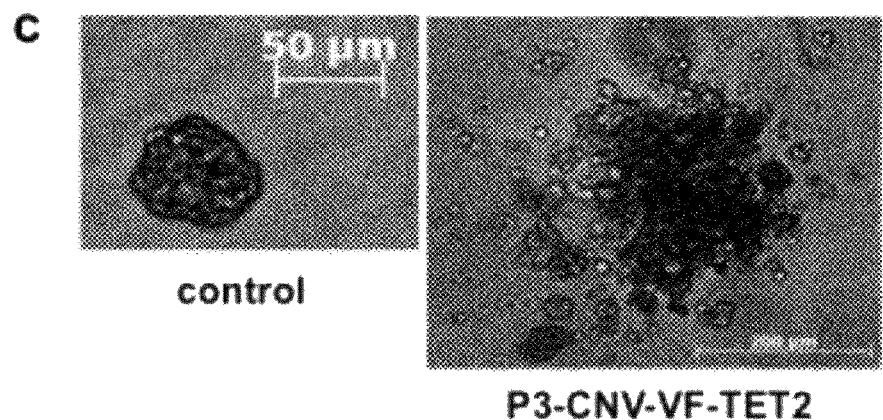
Figure 5:
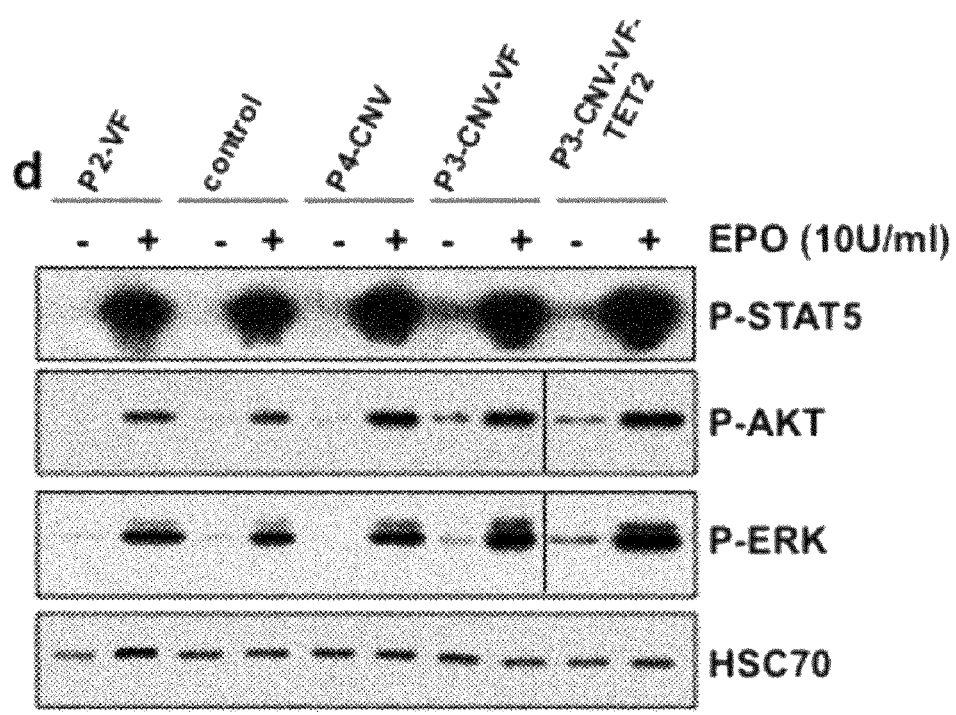
Figure 5:
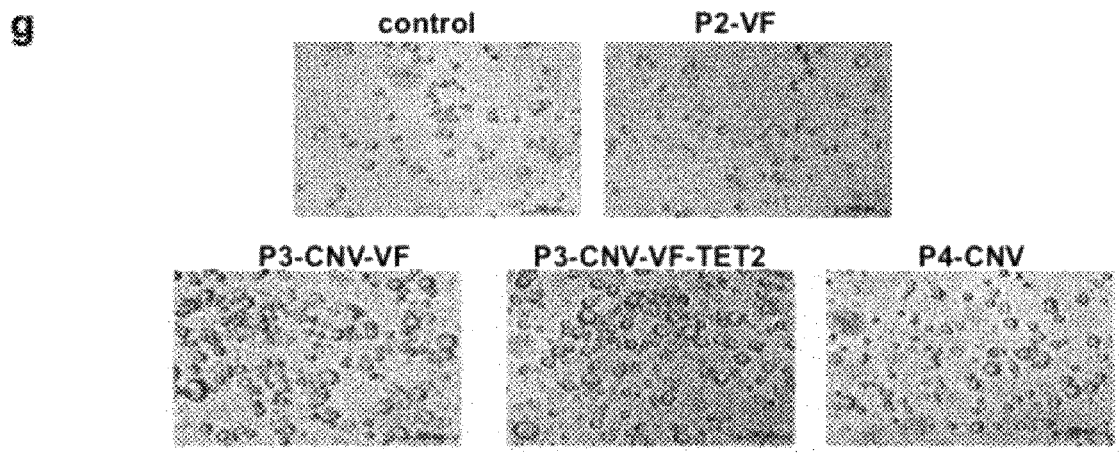

FIG. 5: Duplication modifies the sensitivity to EPO and TPO in IPSC: (a) $GPA^+CD41^+$ cells from P2-VF, P3-CNV-VF, P3-CNV-VF-TET2, P4-CNV or control were plated in methylcellulose in the presence of SCF and increasing concentrations of EPO. EryP colonies were counted 12 days later. (b) The percentage of large Ery-P (>50 cells per colony) was also calculated. Results are the mean±SEM of 2 experiments in duplicata. (c) Pictures of Ery-P. (d) $GPA^+$ cells were cytokine-deprived overnight in serum-free medium and seeded in IMDM alone for 4 hours. Cells were stimulated or not with 10 U/mL EPO and analyzed by Western-blot. (e) $CD41^+$ cells from P2-VF, P3-CNV-VF, P3-CNV-VF-TET2, P4-CNV or control were plated in plasma clots without or with increasing concentrations of TPO. CFU-MK colonies were counted at day 10 after CD41a indirect staining. Results are the mean±SEM of 2 experiments in duplicata. (*$P<0.05$, $P<0.01$, *$P<0.001$, ****$P<0.0001$). (f) CD41+ cells were sorted and grown and the percentage of hyperploid cells (>8n) was calculated after propidium iodide labeling and flow cytometry analysis (mean±SEM, n=5; *P<0.05, **P<0.01). (g) Pictures of MK cells in culture.

Figure 6:
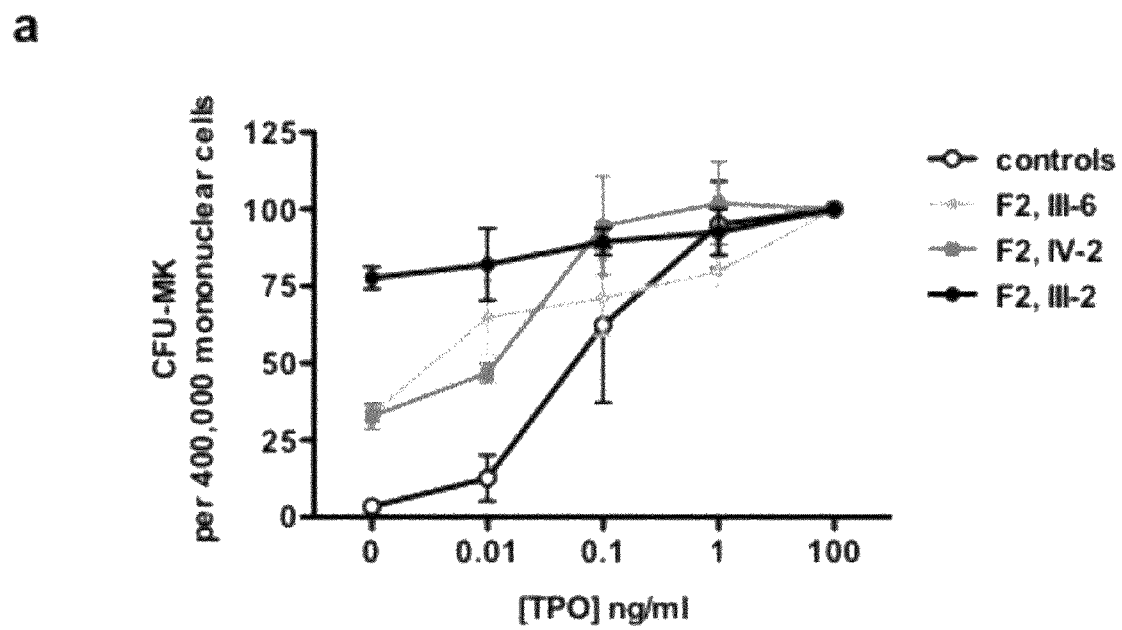
Figure 6:
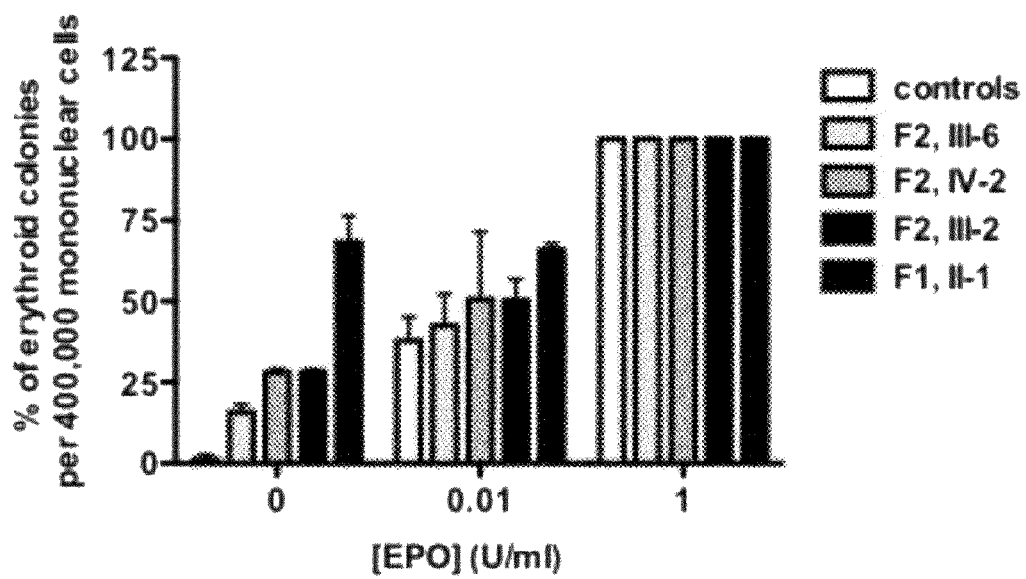

FIG. 6: CNV predisposition modifies the sensitivity to EPO and TPO in primary cells from patients: (a) Primary CD34+ cells from 3 control donors and 4 patients (F2,III-6; F2,IV-2, F2,III-2, F1,II-1) with SCF (25 ng/mL) and in the absence or presence of various doses of TPO or grown either with SCF (25 ng/mL)±IL-3 (10 µg/mL) in the absence or presence of various doses of EPO and cloned in semi-solid conditions either in plasma cloat (a) or in methylcellulose (b and c). The percentage of erythroid colonies or CFU-MK was calculated for each condition compared to the maximum growth. (c) Pictures represent endogenous erythroid colonies (without EPO).

Figure 7:
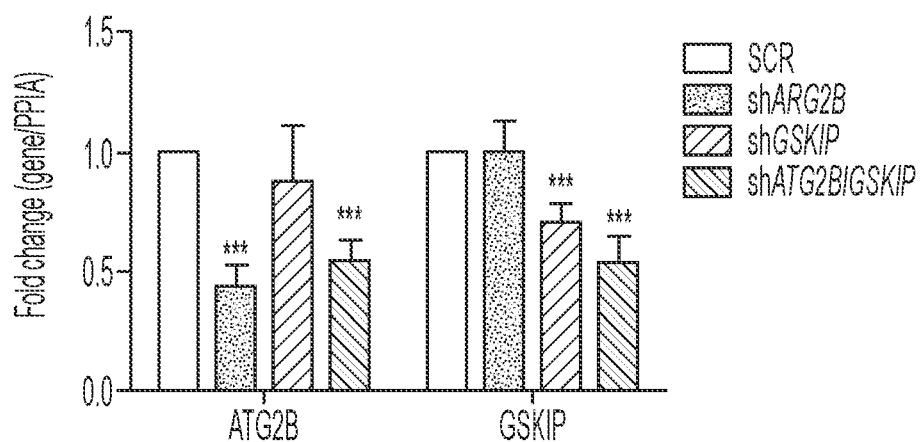
Figure 7:
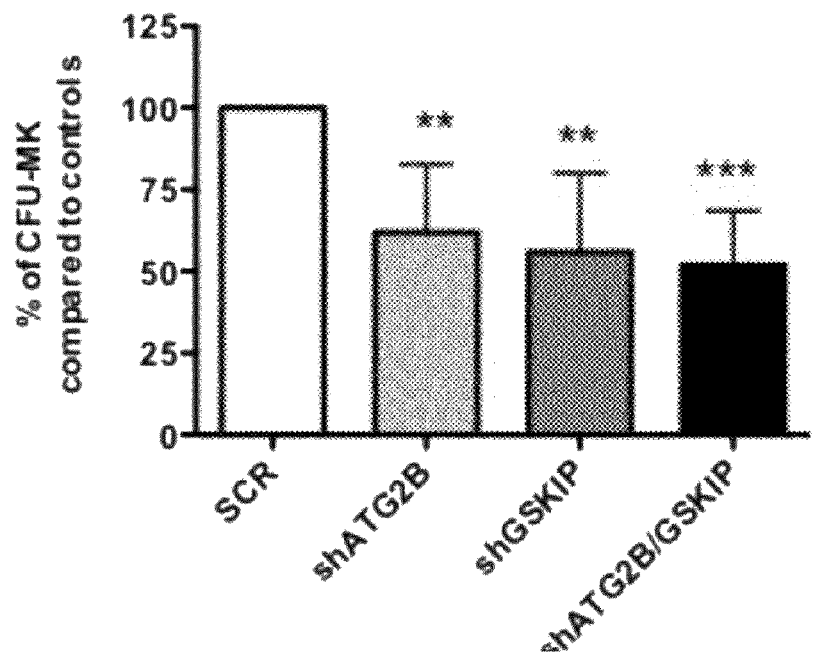
Figure 7:
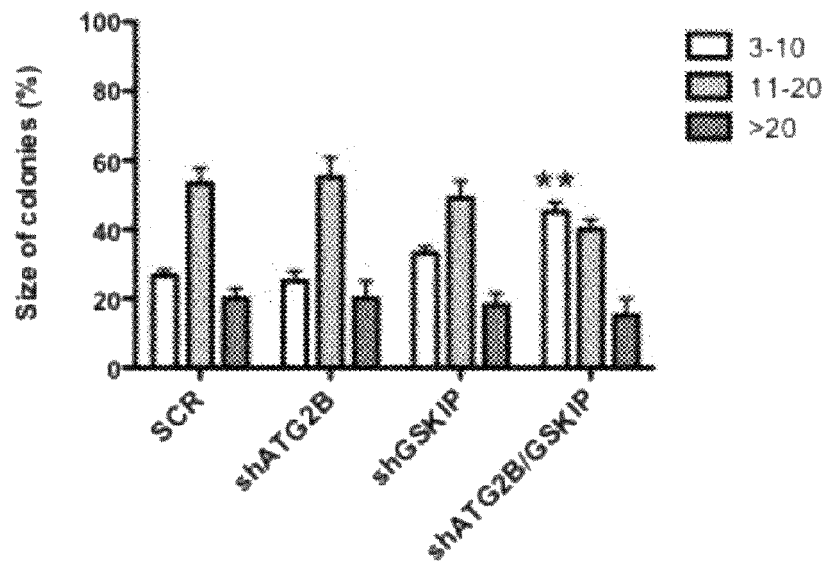
Figure 7:
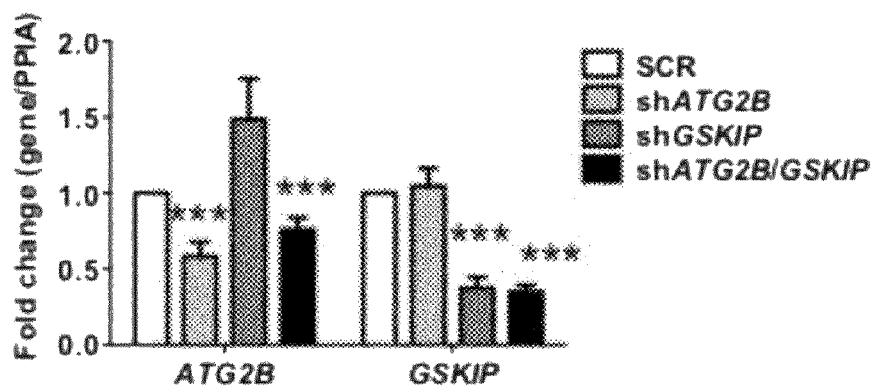
Figure 7:
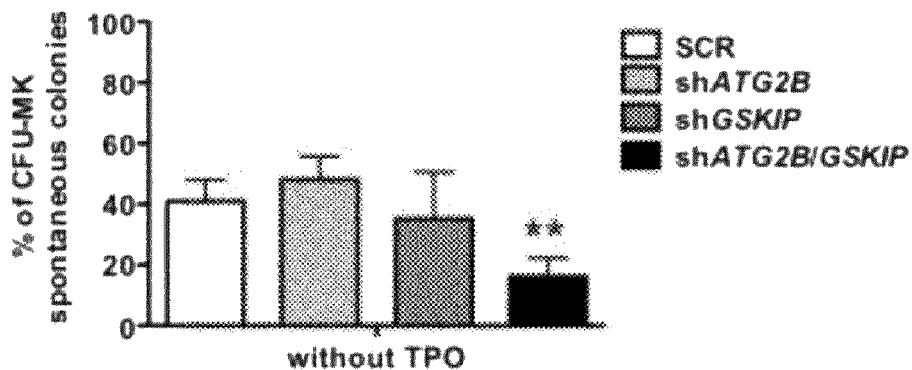
Figure 7:
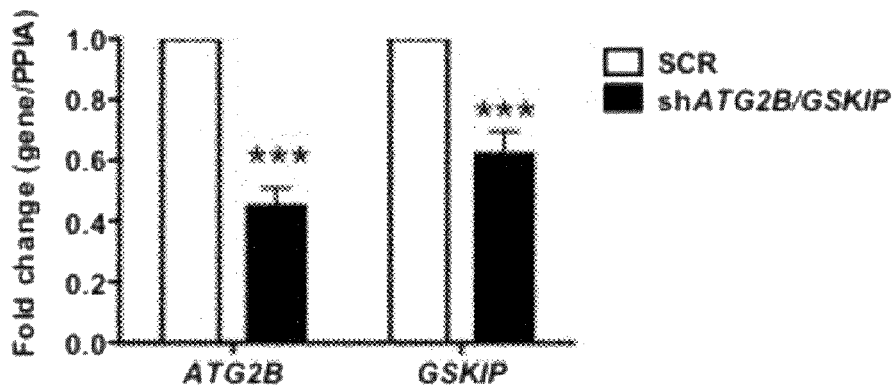
Figure 7:
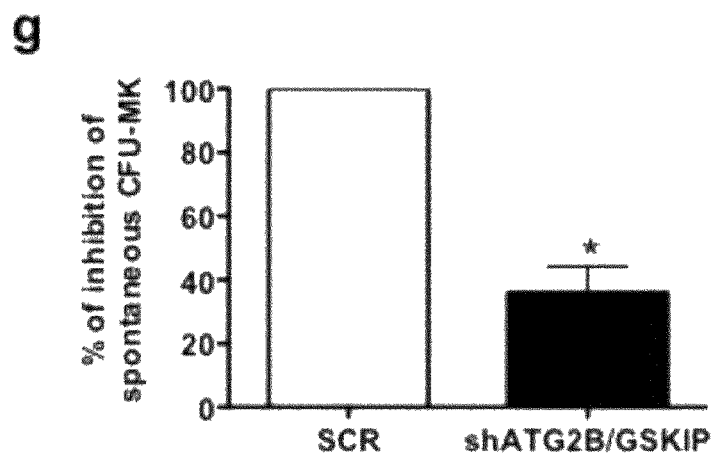

FIG. 7: ATG2B and GSKIP are involved in the phenotype: (a) Primary cells from control donors were transduced with shSCR, shRNAATG2B or shRNAGSKJP or both and relative expression of ATG2B and GSKIP were calculated compared to HPRT or PPIA. (b) CD34+ cells were plated in plasma clot with SCF and TPO and the percentage of CFU-MK was calculated for each condition compared to shSCR (n=3). (c) The CFU-MK colonies were classified depending of the MK cluster size. (d) CD41+ cells derived from P4-CNV were transduced with shRNAATG2B and shRNAGSKIP and relative expression of ATG2B and GSKIP were calculated compared to PPM. (e) iPSC-derived hematopoietic progenitors (CD41+GPA+) were plated in plasma clots with or without TPO and CFUMK colonies were counted at day 10 after CD41a indirect staining. The percentage of spontaneous CFU-MK colonies was calculated for each condition compared to the maximum growth. (f) CD34+ cells from patients were transduced with shSCR or shRNAA TG2B and GSKIP and relative expression of ATG2B and GSKIP were calculated compared to PPIA. (g) CD34+ cells were plated in plasma clot with or without SCF and TPO and the CFU-MK colonies were counted at day 10 after CD41a indirect staining. The percentage of inhibition of spontaneous CFU-MK with shATG2B/GSKIP was calculated compared to SCR condition. All the results are the mean i SEM of at least 3 independent experiments (*P<0.05, P<0.01, *P<0.001, ****P<0.0001).

FIG. 8: Pie chart representation of acquired signaling and epigenetic mutations in MPN from the four families.

Figure 9:
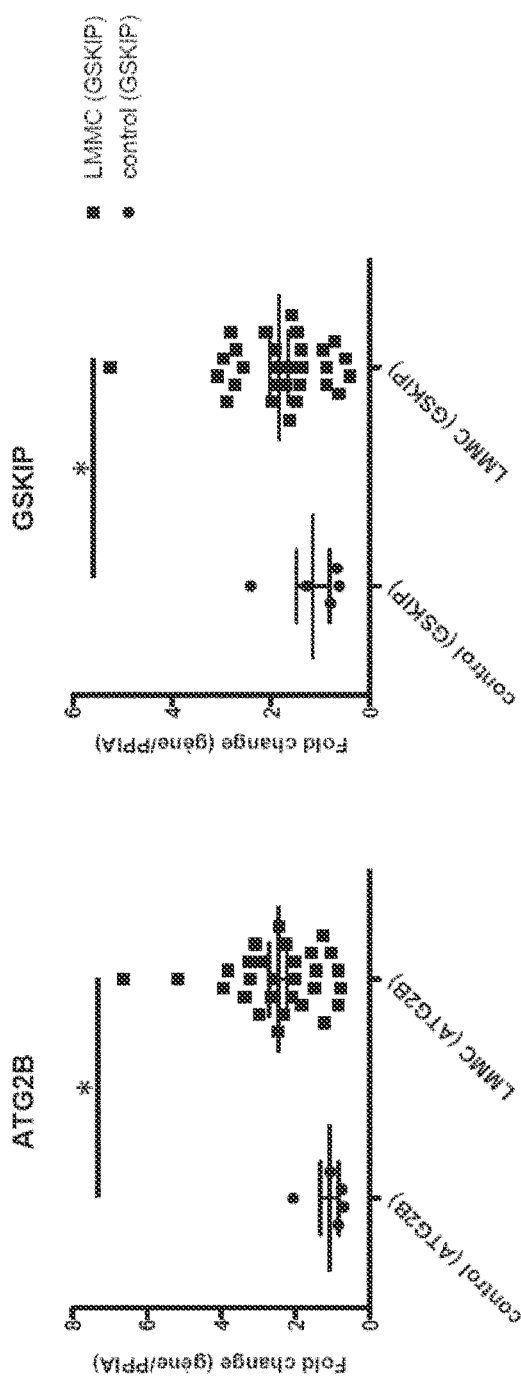

FIG. 9: Determination of deregulation of ATG2B and GSKIP genes In CMML using cohorts. Deregulation of ATG2B and GSKIP gene expression was investigated in a cohort of monocytes (CD14+) from CMML in comparison to normal monocytes from donors by qRT-PCR. 29 cases of CMML were compared to 5 controls.

EXAMPLES

1. Material and Methods
Patients

All participants to this study gave their written informed consent in accordance with the Declaration of Helsinki and the study was approved by the Local Research Ethics Committee from Saint Antoine Hospital (Paris, France). MPN was defined following WHO criteria for ET and MF[48]. Clinical features and hematological parameters were collected at diagnosis and during the course of the disease and recorded in an Access database approved by the French computer commission (CNIL #815419). Four families originating from West Indies were studied and 98 unrelated familial cases collected through a national network were analyzed as controls (as previously described[6,49]). Geographically-matched DNA controls were also used: 39 sporadic MPN cases recruited from the Department of Hematology (Fort de France Hospital) and 199 healthy controls of West Indies origin collected by the Department of Genetics (Pitié-Salpétrière Hospital).

IPSC Generation and Cultures

CD34+ and CD3+ cells were purified from blood mononuclear cells. CD34+CD38− or CD34+CD38+ cells were cultured in serum-free medium with cytokines for 5 days before being infected with VSV-G pseudotyped retroviruses encoding Oct4, c-myc, Klf4 and Sox2[11]. Six days later, cells were seeded on irradiated murine embryonic fibroblasts (MEF) in ES medium[50]. Colonies with an ES-like morphology were picked from day 20 to day 30 and expanded.

Hematopoietic differentiation was performed on OP9 stromal cells in the presence of VEGF (20 ng/mL) (Peprotech, Neuilly-sur-Seine, France)[13]. On day 7, EPO (1 U/mL) (Amgen, Thousand Oaks, Calif.), TPO (20 ng/mL) (Kirin, Tokyo, Japan), SCF (25 ng/mL) (Biovitrum AB, Stockholm, Sweden) and IL-3 (10 ng/mL) (MiltenyiBiotec, Paris, France) were added and on day 11-12, cells were enzymatically dissociated. The recovered cells were cultured or sorted on the expression of GPA and CD41. Clonal differentiation of iPSC was also performed on OP9 cells.

Quantification of Clonogenic Progenitors in Semi-Solid Cultures

Cells were plated either in methylcellulose to quantify erythroid (Ery-P) and granulo-monocytic (CFU-GM) progenitors or in serum-free fibrin clot assays to quantify CFU-MK[51]. Cultures were scored after 12-14 days for all colonies[14]. MK colonies were enumerated at day 10 after labeling by an indirect immuno-alkaline phosphatase staining technique using an anti-CD41a monoclonal antibody (Becton Dickinson, clone HIPS), as previously described[31].

Teratoma Assays and Embryoid Bodies

IPSC (1×10$^6$) were scrapped and resuspended in 140 µL ES medium. Undiluted matrigel (60 µL) was added prior to subcutaneous injection into Rag2−/−γC−/− mice. After 8-12 weeks, tumors were isolated and fixed in 10% formalin. Sections were stained for germ layers analysis. Spontaneous differentiation was generated by embryoid body formation 14.

Antibodies and Flow Cytometry Analysis

Directly conjugated monoclonal antibodies were used for iPSC (SSEA4, eBioscience, San Diego, Calif. and TRA-1-81, Becton Dickinson (BD), le Pont de Claix, France), for sorting and characterization of hematopoietic cells (anti-CD34, Beckman, Villepinte, France; anti-CD43, -CD42 and -GPA, Invitrogen, Cergy-Pontoise, France, and anti-CD41 and -CD14, Pharmingen, San Diego, USA). Cells were sorted on an Influx flow cytometer (BD) and analyzed on a FACS Canto II (BD). iPSC colonies were stained by an alkaline phosphatase (AP) reaction (Stemgent, Cambridge, Mass., USA).

qRT-PCR and Gene Expression Arrays Analysis.

Total RNA was isolated using RNeasy Mini Kit (Qiagen, Courtaboeuf, France) and cDNA was synthesized by SuperScript II Reverse Transcriptase (Invitrogen). PCRs were carried out in the ABI Prism GeneAmp 7500 Sequence Detection System (Applied Biosystem), using the Power SYBR Green PCR Master Mix (Invitrogen) and Taqman gene expression assays for TCL1A, BDKRB1, BDKRB2, ATG2B, GSKIP (Applied Biosystem). All genes were expressed relatively to PPIA or HPRT.

For microarray analysis, RNA was hybridized on Agilent 4X44K arrays following manufacturer's procedures. Analysis was performed using Bioconductor and Rosetta Resolver® (Microsoft corp, NY, USA). Gene set class comparison was performed with KEGG to classify regulated genes.

Karyotypes and CGH Arrays

CGH arrays from CD34+ cells or IPSC were conducted on human CGH 2×400K (G4448A) by hybridization of sample versus normal-matched commercial reference and a hierarchical clustering was performed. Karyotypes were performed using standard procedures on R-banded metaphases (450-600 bands).

Linkage Analysis, Microsatellite Genotyping and Single Nucleotide Array Analysis Families 1 and 2 were subjected to a genome scan using the 6 K Illumina Linkage IVb mapping panel on a Bead Station system (Illumina Inc. San Diego, Calif., USA). Allele detection and genotype calling were performed using the Bead Studio software (Illumina Inc.). Genotype data from the genome scan were subjected to parametric linkage analyses in MERLIN using a dominant model with incomplete penetrance (0.8), a disease allele frequency of 0.000005 and no phenocopy.

Single Nucleotide Polymorphism (SNP) Array Analysis.

Five affected cases (FIG. 1: F1,II-2, F1,II-5, F1,II-7; F2,III-2 and F2,III-7) and one unaffected control (F1,I-2) were genotyped using the Illumina's Human CNV 370 bead ship (IlluminaInc, San Diego, USA). Results were analyzed with the genome viewer of the Illumina GenomeStudio software. The duplicated region was further confirmed by real-time quantitative PCR based on SYBR-Green I fluorescence using an ABI 7900 Sequence Detection System (Life technology, Thermoscientific, Saint Rémy-les Chevreuses). Primers were designed in two genes in the proximal and the distal part of the duplicated region, and the PCR was carried out in a 20 µl reaction using the SYBR-green I PCR master mix (Life technology) using 300 nmol/l of each primer and 20 ng of DNA. The b-globin gene (HBB) was used as reference. The number of copies was determined as previously described[52].

Primers are available in the following Table:

| | sequence | Location of the amplicon (kb) (hg19) | |
|---|---|---|---|
| Chr14_B1-C1F | ATGCTCTTGCAGCTACTCAGC | 96,156 | mapping of |
| Chr14_B1-C1R | CGGCAAAATCTCTCCTTCTCT | | the proximal |
| Chr14_B1-C2F | TTCCTACCCACAGAAATGTGC | 96,160 | breakpoint |
| Chr14_B1-C2R | AAGAAGGCAGCTAAGGGACTG | | through Q- |
| Chr14_B1-C2.1F | GAGTCACACTTTGGGATCTGC | 96,161 | PCR |
| Chr14_B1-C2.1R | TAACAGTTGGGGCAGAACAAG | | |
| Chr14_B1-C2.2F | CCCACCCAAACTAATCTGTGA | 96,162 | |
| Chr14_B1-C2.2R | TAGGACGCAGACACACACAAG | | |
| Chr14_B1-C2.3F | GGAAATTGCAGTGAGGTGAGA | 96,163 | |
| Chr14_B1-C2.3R | AGAAGGTCTGAATTGCACCTG | | |
| Chr14_B1-C3F | CTTTCCTGGTCACATTTTCCA | 96,164 | |
| Chr14_B1-C3R | TTAGCATTTTCAGCTGGGCTA | | |
| | | | |
| Chr14_B2-C1F | CACCAATCCTTGCTGAGTTGT | 96,855 | mapping of |
| Chr14_B2-C1R | CATTAGTAGCAGCCGAACCTG | | the distal |
| Chr14_B2-C2F | GGACTTGCCCAAGATCACATA | 96,859 | breakpoint |
| Chr14_B2-C2R | TTAGCTGCCTGCTTCAAAATC | | through Q- |
| Chr14_B2-C2.1F | AAGGACACCAGTTGTTGGATG | 96,860 | PCR, |
| Chr14_B2-C2.1R | GAACCTGTGAATGTGGCCTTA | | |
| Chr14_B2-C2.2F | GCCAGGAGTTTGGTTTATCCT | 96,861 | |
| Chr14_B2-C2.2R | TGCCCAGCCTGTATCTGTATC | | |
| Chr14_B2-C2.3F | AGGCAGAGGATGAAGAAGAGG | 96,862 | |
| Chr14_B2-C2.3R | CAGGTGACCCTTGAACAACAC | | |
| Chr14_B2-C3F | AGGCAACATAGCAAGACCACA | 96,864 | |
| Chr14_B2-C3R | AGGAACTCAGGGTCAGAGAGC | | |
| | | | |
| Chr14dup_joncF* | TGGGCGTGGTGTAATACTAGC | 96,860 | junction |
| Chr14dup_joncR** | TGGCCGTTCTGTTTATTGTTC | 96,163 | sequencing |
| | | | |
| ATG2B_ex36F | GTCTCCTGGAGCTGATGTCAC | 96,761 | CNV |
| ATG2B_ex36R | GCCATTAACCACTTCCACTGA | | screening |
| TCL1A_ex2F | TACAGTTACGGGTGCTCTTGC | 96,178 | |
| TCL1A_ex2R | GGGTAGAGCTGCCACATGATA | | |
| | | | |
| HBB_F | GTGCACCTGACTCCTGAGGAGA | | |
| HBB_R | CCTTGATACCAACCTGCCCAG | | |

A total of 16 microsatellite markers spanning the chromosome 14 candidate regions were added in the analysis. All microsatellites were analyzed by electrophoresis on the ABI3730 Genetic Analyzer (PE Applied Biosystems) and data collected and analyzed using GENESCAN™ software Version 4.0 (PE Applied Biosystems). Multipoint parametric linkage analysis was performed in ALLEGRO using a dominant model with incomplete penetrance (0.8), a disease allele frequency of 0.000005 and no phenocopy. Microsatellite allele frequencies were deduced from a matched control population (n=33).

Characterization of the Duplication

The breakpoints of the duplicated motif were determined by real-time quantitative PCR based on SYBR-Green I fluorescence. Oligonucleotides were designed for 12 amplicons between 100 and 200 bp long (see table above). Refinement of the breakpoints and determination of the orientation of the two duplicated motifs were assessed by PCR, agarose gel electrophoresis (Chr14_B2C2.1F and Chr14_BIC2.3R, FIG. 2c) and sequencing analysis. (Chr14_B2C2.1F/Chr14dup_joncR and Chr14dup_joncF/Chr14_BIC2.3R, FIG. 2d).

Targeted Sequencing and Whole Exome Sequencing (WES)

Primers were designed with Primer3plus. The coding sequence and exon-intron boundaries of candidate genes were amplified and PCR products were sequenced in both directions with the ABI PRISM Big Dye Terminator v1.1 Ready Reaction Cycle Sequencing kit (Life Technologies, France) on an ABI PRISM 3730 Genetic Analyzer. Sequences were analyzed with Seqscape software v 2.2 (Life Technologies) and identified variants were analyzed with AlamutV2 software (Interactive biosoftware, France). Signaling mutations of JAK2 (c.1849G>T, pV617F), MPL (c.1544G>T, p.W515L) and CALR (c.1099_1150del, p.L367Tfs*46 and c.1154_1155ins, p.K385Nfs*47) were analyzed as previously described.[53] The spectrum of other acquired events was determined by Sanger sequencing IDH1/2 (exons 4 and 5), ASXL1 (exons 12 and 13) and the entire coding region of TET2, EZH2, DNMT3A and TP53. The WES was performed using HiSeq2000 after capture with Agilent kit. The results were analyzed by comparing $CD3^+$ non-tumoral cells to either $CD34^+$ cells or to iPSC and $CD34^+$ to iPSC.

Western Blot Analysis

Signaling studies were performed on cultured erythroblasts after overnight cytokine deprivation in serum-free medium. Stimulation by EPO (10 U/mL) for 15 minutes serves as positive control. Samples were subjected to Western blot analysis using polyclonal antibodies against the phosphorylated forms of STAT5(Tyr 694), ERK1/2(Thr 202/Tyr 204), AKT (Ser 473) (Ozyme). HSC70 was used as loading control and was from Stressgen (Victoria, Canada).

Constructs and Viral Particles Production

Sequences for human shRNA were for AT2B (5'ATGCAATACTGTCACTATAAACTCGAGTT-TATAGTGACAGTATTGCA3') and for GSKIP (5'GGACAAACTTTGTAGTAATTACTCGAGTAATTAC-TACAAAGTTTGTCC3') were vectorized either in PLKO.1-puromycin-Ubc-turboGFP (Sigma-Aldrich, Saint Quentin Fallavier, France) or in PRRLsin-PGK-eGFP-WPRE for shGSKIP or in PRRLsin-PGK-mcherry-WPRE for shATG2B vectors (Genethon, Evry, France). Lentivirus particles were produced as previously described[54]. iPSCs-derived $CD34^+$ or $CD34^+$ cells were transduced with shG-SKIP or shATG2B lentivirus and sorted for GFP or mcherry, respectively, on BD influx sorter. Alternatively, selection with puromycin was used.

2. Results

Identification of a 700 kb CNV in the Chromosome 14 as a Predisposition Locus.

Two large families (F1 and F2) were identified from French West Indies, with distinct clinical features from other familial cases of MPN (FIGS. 1A and D). Adult-onset ET rapidly progresses to MF and MDS/AML (20/32) in these families with an autosomal dominant inheritance of MPN (Table 1). The genetic linkage analysis of the two families identified a positive linkage on the 14q32.13-q32.2 locus (Lodscore Zmax=3.7) (FIG. 2a). Using additional microsatellite markers and taking advantage of a crossing-over in one patient (F1, II-7) and in an ancestral patient from F2, the susceptibility region was further narrowed down to a 1.86 Mb interval (95.76 Mb-97.62 Mb, hg19) ( ). Sequencing of the 1.86 Mb candidate locus did not identify any germline mutation in coding regions that segregate with the disease (not shown). The SNP array analysis detected a 700 kb duplication located within the linkage region and absent from the database of genomic variants (DGVS, v10) (FIG. 2b).

Figure 2E:

The presence of the CNV was further confirmed in all affected cases in both families by real-time quantitative PCR (FIG. 1). PCR analyses mapped the proximal and distal breakpoints of the CNV and established this duplication as a 700 kb head-to-tail tandem duplication (FIGS. 2c and d). This region includes TCL1A, GSKIP, ATG2B, BDKRB1, and BDKRB2 genes, together with the first exon of AK7 gene (FIG. 2e). Using quantitative PCR, the same CNV was identified in two other families (F3 and F4, FIGS. 1B and D). These families shared with the two initial families their geographical origin and the clinical features.

Analysis of the four families demonstrated the high penetrance of the phenotype since 23 out of 34 carriers of the germline CNV developed a MPN (FIG. 1 A to D). This CNV was not identified in 199 control DNA of the same geographical origin and in 98 unrelated Eurocaucasian familial MPN cases.

TABLE 1

| Family | ID[a] | Gender | Initial diagnosis | Age at diagnosis, y | Follow-up duration, y | Evolution | Outcome |
|---|---|---|---|---|---|---|---|
| F1 | I.1 | Male | CMML[b] | 75.4 | 0.5 | AML4[c] | died |
| F1 | II.1 | Female | ET[d] | 63.5 | 7.5 | AML | alive |
| F1 | II.2 | Female | ET | 39.5 | 20.2 | MF | died |
| F1 | II.3 | Female | ET | 38 | 17 | MF > AML | died |
| F1 | II.5 | Female | ET | 41.2 | 21.8 | | alive |
| F1 | II.6 | Male | ET | 36.8 | 17 | | alive |
| F1 | II.7 | Male | AML2 | 43.6 | 7.9 | | HSCT, alive |
| F1 | III.1 | Male | ET | 34 | 8 | AML | died |
| F1 | III.4 | Male | ET | 35.5 | 8.5 | | alive |
| F2 | II.1 | Male | ET | 81 | 0.5 | AML | died |
| F2 | II.2 | Female | CMML | 52 | 1 | AML | died |
| F2 | II.3 | Female | CMML | | na | AML | died |
| F2 | III.1 | Female | AML2 | 37.5 | 0.5 | | died |
| F2 | III.2 | Female | ET | 49 | 11 | MF | alive |
| F2 | III.4 | Female | aCML[g] | 48 | 0.9 | AL | died |
| F2 | III.7 | Male | ET | 36 | 22 | AML | HSCT, alive |
| F2 | III.8 | Male | CMML | 45.5 | 0.5 | | alive |
| F2 | III.9 | Male | ET | 25 | 25 | AML | HSCT, died |
| F2 | III.10 | Female | ET | 34 | 14 | CML, MF | alive |
| F2 | III.11 | Female | ET | 41.5 | 5.5 | | alive |
| F2 | III.13 | Female | AML2 | 35 | 0.8 | | HSCT, died |
| F2 | IV.2 | Female | ET | 33 | 4 | | alive |
| F2 | IV.4 | Male | PMF[h] | 36 | 0.5 | | alive |
| F2 | IV.11 | Male | AML6 | 34 | 1.6 | | died |

TABLE 1-continued

| | | | | | | |
|---|---|---|---|---|---|---|
| F3 | II.1 | Female | AML5 | 64.8 | 0 | died |
| F3 | II.2 | Female | ET | 46.3 | 20.2 | alive |
| F3 | III.1 | Female | ET | 42 | 8 | alive |
| F3 | III.2 | Female | ET | 34 | 11 | alive |
| F3 | IV.1 | Female | ET | 29 | 2 | alive |
| F4 | II.1 | Male | ET | 43.8 | 0.6 | alive |
| F4 | II.2 | Female | ET | 42 | 0.2 | alive |
| F4 | II.3 | Male | PMF | 38.5 | 0.8 | HSCT, alive |

| Family | Signaling mutations | Epigenetics mutations | Karyotype |
|---|---|---|---|
| F1 | na | na | 46.X.Y.del(13)(q12a22)[1]/46.XY. del(13)(q12q22),t(1;1)(p34.3p36.3). t(2;20)(p13;q11.2)t(4;12)(q12;q15). add(5)(q35)[16] |
| F1 | JAK2:p.V617F (45%)[e] | IDH1:c.394C > T.p.R132C | 46.XX.−7[10]/4.−7.+11/46XX |
| F1 | JAK2:p.V617F (84%) | IDH2:c.419G > A.p.R140Q | 46.XX.der(6)t(6;?)(p25)[7]/ 46.XX.dup(12)(q13q22)[2]/46.XX[8] |
| F1 | JAK2:p.V617F (48%) | IDH2:c.563G > A.p.R188Q TET2:c.1648C > T.p.R550X/ c.2567delG.9.G856fs | 46.XX.+1.der(1;7))q10;p10)[11]/ 46.XX[5] |
| F1 | JAK2:p.V617F (62%) | IDH1:c.394C > A.9.R132S IDH2:c.563G > A.p.R188Q | 46.XX |
| F1 | Triple negative[f] | IDH2:c.563G > A.p.R188Q TET2:c.3321dup.p.S1107fs | 46.XY[20] |
| F1 | Triple negative | IDH1:c.394C > T.p.R132C | 46.XY.−7.+14[12]/46.XY[11] |
| F1 | CALR:c.1099_1150del52 (30%) | TET2:c.2058A > T.p.R686S | 45.XY.−5.der(6)t(6;8)(p22;q21). −17+mar[16]/46.XY[1] |
| F1 | JAK2:p.V617F (2%) | none | na |
| F2 | na | na | na |
| F2 | na | na | na |
| F2 | na | na | na |
| F2 | na | na | na |
| F2 | JAK2:p.V617F (49%) | TET2:c.3500+3A > C | 46.XY.inv(2)(p24q14)[11] |
| F2 | Triple negative | TET2:c.1954delC.p.Q652fs/ c.2490dupA.p.Q831fs ASCL1:c.2893C > T.p.R965* | 46.XX.−7[20] |
| F2 | CALR:c.1099_1150del52 (5%) | none | 46.XY.inv(2)(p24q11)c[23] |
| F2 | JAK2:p.V617F (38%) | TET2:c.4469delA.p.E1490fs | 46.XY.inv(2)(p25q13)[25] |
| F2 | MPL:p.W515L (5%) | TET2:c.5551G > T.p.E1851* | 46.XY.inv(2)(p2?5q1?4)[20] |
| F2 | CALR:c.1099_1150del52 (35%) | none | 46.XX[22] |
| F2 | Triple negative | TET2:c.3804-2A > T | na |
| F2 | na | na | na |
| F2 | JAK2:p.V617F (1%) | none | 46.XY.inv(2)(p24q14)[11] |
| F2 | JAK2:p.V617F (72%) | ASXL1:c.1934dup.G646fs | 46.XY |
| F2 | na | na | 46.XY.−7[18] |
| F3 | na | na | 46.XX.+4.+8[15] |
| F3 | JAK2:p.V617F (5%) | TET2:c.3689delT.p.I1230fs | 46.XX [15] |
| F3 | Triple negative | none | na |
| F3 | Triple negative | none | na |
| F3 | JAK2:p.V617F (11%) | na | na |
| F4 | CALR:c.1099_1150del52 (10%) | none | 46.XY [20] |
| F4 | Triple negative | none | na |
| F4 | JAK2:p.V617F (61%) | none | 46.XY [20] |

[a]ID according to pedigrees shown in FIG. 1.
[b]CMML chronic myelomoncytic leukemia.
[c]AML acute myeloid leukemia.
[d]ET essential thrombocytemia.
[e]allelle burden indicated into brackets.
[f]Triple negative individual defined by the absence of the V617F mutation in JAK2. W515R mutation in MPL and the 52-bp deletion (p.L367Tfs*46) or the 5-bp insertion (K385Nfs*47) in CALR.
[g]aCML atypical chronic myeloid leukemia.
[h]PMF primary synthesis, myelofibrosis.
na non available.

Expression of the Genes Contained in the Duplication

Using gene expression arrays, it was found that 3 out of the 6 duplicated genes were expressed in EBV cell lines (EBVC), namely TCL1A, ATG2B and GSKIP genes. However, only ATG2B and GSKIP were detected in microarrays from CD34+ hematopoietic progenitors, CD36+ erythroblasts and CD41+ megakaryocytes (MK) at a level close to that of RUNX1 in CD41+ and CD34+ cells and to that of STAT5A/B in CD36+ cells (FIG. 3a). Microarrays revealed a significant increase in ATG2B and GSKIP in EBVC from 5 patients compared to EBVC from 3 control relatives, but no difference for TCL1A (FIG. 3b). The expression of these 2 genes was further analyzed during normal in vitro erythroid and MK differentiation from CD34+ progenitors. Different cellular fractions were sorted by flow cytometry and the expression levels of ATG2B and GSKIP were quantified by qRT-PCR (FIG. 3c). GSKIP expression did not vary while ATG2B decreased during MK and erythroid differentiation. A strong increase in ATG2B expression was observed in terminal erythroid differentiation. This was confirmed by qRT-PCR the overexpression (2 to 3 fold) of ATG2B and GSKIP in MK from patients as compared to controls (FIG. 3d).

Derivation of Human Induced Pluripotent Stem Cells (IPSC)

In order to analyze the consequences of the predisposing duplication, iPSC were generated from CD34*-sorted progenitor cells of 2 patients of the same family to reduce the genetic heterogeneity (F2, III-2, iPSC/P3 and F2, IV-2, iPSC/P4).[11] Patient F2, III-2, who developed an ET that rapidly evolved to MF, demonstrated a JAK2V617F mutation (allele burden in granulocytes, 50%) and a heterozygous TET2 mutation (c.3500+3A>C) with decreased 5-hydroxymethylcytosine (5hmC) levels ( ). Patient F2, IV-2, who developed an ET with a platelet count slightly above the normal value (450-550×10$^9$/L), demonstrated a JAK2V617F mutation with very low allele burden (<1% in granulocytes).

Clones bearing the CNV predisposition only (P4-CNV) were obtained from F2/IV-2 patient, and clones harboring the CNV and JAK2$^{WT/V617F}$, with (P3-CNV-VF-TET2) or without (P3-CNV-VF) TET2 mutation were obtained from patient F2,III-2, respectively ( ). iPSC clones were used as controls as previously published. They were obtained by reprogramming healthy donor (control) and sporadic JAK2$^{WT/V617F}$ MPN (P2-VF) CD34-positive cells, respectively.[12] All these clones formed embryonic stem cell (ES)-like colonies. Two clones of each genotype (a or b) were selected, their genomic characterization using CGH arrays, cytogenetics, and whole exome sequencing (WES) was performed ( ) and their phenotype validated while checking for the silencing of transgenes, the re-expression of endogenous pluripotent transcription factor, and their ability to generate embryonic bodies in vitro and to form teratomas in vivo.

CNV Predisposition Increases IPSC-Derived Hematopoietic Cells Generation

To explore the hematopoietic differentiation of iPSC clones, sac-like structures were dissociated at day 12 and cultured on OP9 cell line in the presence of cytokines.[13] First, when hematopoietic progenitor colonies were enumerated 10-12 days after seeding day 13-unfractionated cells in semi-solid medium, a 10-fold increase was observed in the number of colonies in samples carrying the CNV predisposition alone, regardless of an additional mutation in JAK2 or TET2 genes, compared to controls (FIG. 4a).

Figure 4B:
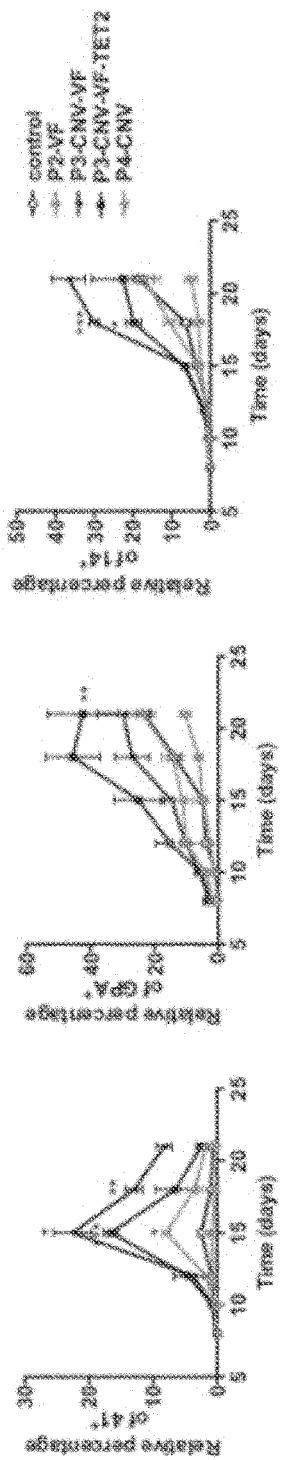
Figure 4C:
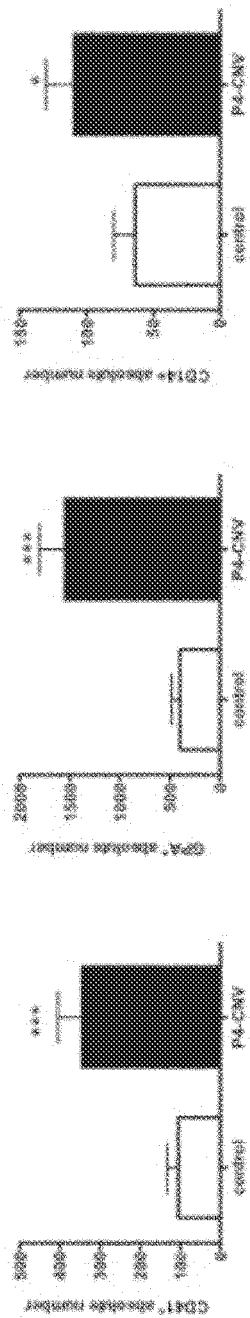

Second, kinetic analyses were performed from day 10 until day 21 and the percentage of MKs (CD41$^+$), erythroblasts (GPA$^+$) and monocytes (CD14$^+$) were determined as previously described[12,14,15]. P2-VF (JAK2$^{WT/V617F}$) did not reveal marked differences in the expression of hematopoietic markers compared to control iPSC, while all the iPSC carrying the CNV predisposition presented a significant increase in MK cells (FIG. 4b). These increases were further enhanced by JAK2V617F mutation in P3-CNV-VF and were even more remarkable, especially for erythroblasts, in P3-CNV-VF-TET2 mutated for both JAK2 and TET2. Finally, when TRA-1-81$^+$-iPSC were sorted and cloned on OP9 cells with a cocktail of cytokines, a significant increase was observed in the absolute number of CD41$^+$, CD14$^+$ and GPA$^+$ cells generated by P4-CNV compared to control-derived iPSCs at day 18 (FIG. 4c).

These results indicate that the CNV predisposition could be sufficient to increase the generation of hematopoietic progenitor cells and the overproduction of erythroblasts, MK and monocytes, an effect enforced by additional mutations in JAK2 and/or TET2.

CNV Predisposition and the Response of Hematopoietic Progenitors to Cytokines

Since hypersensitivity of hematopoietic progenitors to cytokines is a characteristic feature of MPNs,[16] iPSC clones were cultured on OP9 stromal cells for 12 days in the presence of VEGF and hematopoietic cytokines, then sorted the progenitor cell fraction GPA$^+$CD41$^+$ that was grown for 12 days in methylcellulose in the presence of SCF and increasing EPO concentrations. The response to EPO was equivalent in control, P2-VF, and P4-CNV-derived cells. In contrast, P3-CNV-VF and P3-CNV-VFTET2-derived cells demonstrated an increased sensitivity to EPO with around 30% endogenous erythroid colonies (EEC) (FIG. 5a). Moreover, the percentage of large primitive erythroblast (EryP) colonies was higher in P3-CNV-VF-TET2 compared to P3-CNV-VF and control-derived cells, respectively (FIG. 5b, c).

JAK2 is a key molecule in the cytokine-receptor signaling cascade and JAK2V617F induces a constitutive activation of downstream signaling pathways in cell lines and primary cells[17]. IPSC derived erythroblasts were expanded in liquid cultures in the presence of EPO and SCF from day 12 to day 18, and deprived of cytokines. A constitutive STAT5, ERK and AKT phosphorylation was observed only in P3-CNV-VF and P3-CNV-VF-TET2 (FIG. 5d) confirming their EPO-independent growth. This effect was not observed in P2-VF, only bearing a heterozygous JAK2V617F mutation nor for P4-CNV. EPO induced the phosphorylation of STAT5, ERK and AKT in all the erythroblasts, whatever their genotype. All these results argue for a synergistic effect of the CNV predisposition with JAK2$^{V617F}$ and TET2 mutations on erythroid progenitor sensitivity to EPO.

The TPO sensitivity of MK progenitors was subsequently explored. As described above, day 12 GPA$^+$CD41$^+$ progenitors were sorted and grown for 12 days in serum-free fibrin clots in the absence or presence of increasing TPO concentrations. Rare TPO-independent MK colonies, around 10% of maximally TPO-stimulated cultures, were obtained from MK progenitors generated from control iPSC in contrast to 50% TPO-independent MK colonies for JAK2$^{WT/V617F}$ IPSC as described 12 (FIG. 5e).

Interestingly, the predisposition locus alone (P4-CNV derived cells) also caused a similar induction of TPO-independent MK (around 40%), an effect that was further increased by the JAK2$^{V617F}$ mutation (P3-CNV-VF derived cells), whereas TET2 mutation did not further modify the response to TPO in P3-CNV-VF-TET2 derived cells. Finally, when GPA$^+$CD41$^+$ progenitors were cultured in the presence of SCF and TPO, MK derived from all iPSC harboring the predisposition locus showed a significant augmentation in hyperploid MK cells (FIGS. 5f and g).

Figure 6C:
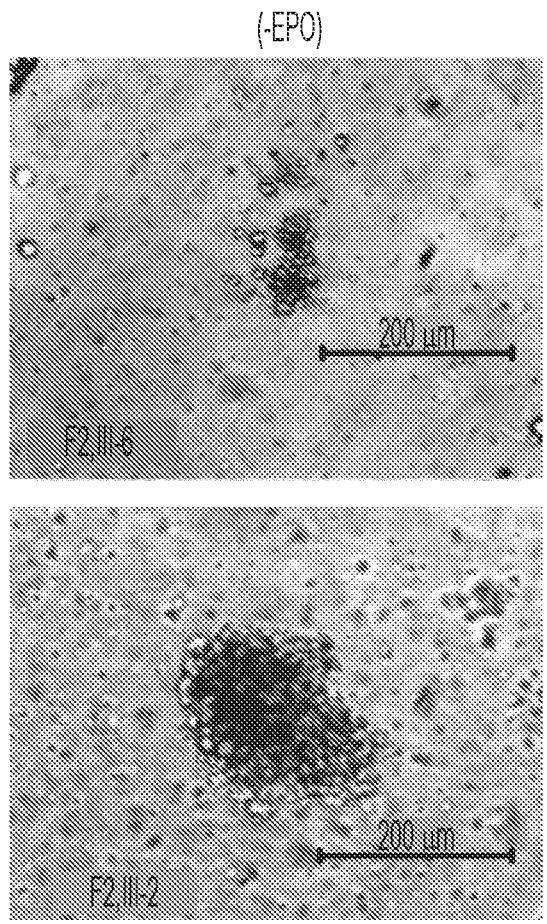

To validate these observations, CD34+ progenitors from patients, including F2,III-6 (CNV alone), F2,IV-2 (CNV+ low JAK2$^{V617F}$ burden), F2,III-2 (CNV and JAK2$^{V617F}$+ TET2 mutation) and F1,II-1 (CNV+JAK2$^{V617F}$) were studied, and their ability to form EEC and endogenous CFU-MK was explored. It was observed that the CNV alone promoted the spontaneous growth of CFU-MK and that this effect was enforced by JAK2$^{V617F}$ (FIG. 6a). A tiny spontaneous EEC was also detected with the CNV alone, that was further enhanced by JAK2$^{V617F}$ mutation in F2,IV-2 and F1,II-1 patients (FIG. 6b). The TET2 mutation did not display additive effect to this response but rather impacted the size of the colonies and thus the proliferation of erythroblasts (F2, III-6 versus F2, III-2, FIG. 6c). Taken together, the CNV predisposition promotes megakaryopoiesis by inducing the CFU-MK spontaneous growth and the generation of hyperploid MK. The CNV predisposition also cooperates with JAK2$^{V617F}$ to modify the response of hematopoietic progenitors to EPO.

Characterization of Genes Involved in the Phenotype

To investigate the function of ATG2B and GSKIP in hematopoiesis, CD34$^+$ progenitor cells were transduced with a lentivirus expressing either short hairpin RNA (shRNA) targeting these genes or a scramble sequence (SCR), and GFP as a selection marker. shATG2B and shGSKIP alone or in combination induced about 40-50% reduction in the transcripts of their respective targets (FIG. 7a). Their effect was observed on MK progenitors and it was found a significant decrease in the frequencies of CFUMK with each shRNA or used in combination. In addition, the simultaneous silencing of both ATG2B and GSKIP led to a further decrease in CFU-MK size (FIGS. 7b and c).

To confirm the role of these genes in the consequences of the genomic duplication, the shRNA were transduced, alone or in combination, in CD41$^+$GPA$^+$ progenitors generated from P4-CNV iPSC at day 12, and progenitors were grown for 12 additional days in serum-free fibrin clots in the absence or presence of TPO (FIG. 7d). Transduction of shATG2B or shGSKIP alone had no impact on spontaneous CFU-MK growth, but their combination induced a major inhibition of TPO-independent CFU-MK growth (FIG. 7e). The role of ATG2B and GSKIP on MK spontaneous growth was further confirmed by transducing both shRNA in CD34$^+$ progenitors from patients (FIGS. 7f and g).

Conversely, no effect of TCL1A downregulation was detected by using shRNA in the same conditions, and overexpression of TCL1A gene in CD34$^+$ progenitor did not induce spontaneous MK growth (not shown). Altogether, both ATG2B and GSKIP are responsible for the MK phenotype induced by the CNV predisposition. KEGG analysis of the gene differentially expressed between controls and patients EBVC showed 8 significantly different gene set classes, and point to an abnormal function of endoplasmic reticulum with deregulated chaperoning and glycosylation as well as taurine and hypotaurine metabolism ( ).

Molecular Characterization of the MPN Cases and Progression to AML in the Four Families Analysis of genetic abnormalities associated with disease development collected from 24 members of these families identified a signaling mutations profile in MPN (ET or PMF) similar to that observed in sporadic cases: JAK2V617F (15/22, 68%), MPL mutants (2/22, 9%), CALR mutants (4/22, 18%) and triple negative (1/22, 5%) (Table 1 and FIG. 8). Sequencing performed on the most recent samples showed the acquisition of secondary events in TET2 (n=7/21, 38%), IDH1 (n=2/21, 10%),IDH2 (n=4/21, 19%) and ASXL1 (n=1/21, 5%) genes with disease evolution to myelofibrosis and leukemia (Table 1 and FIG. 8). Several patients exhibited biallelic mutation of TET2 or combination of epigenetic mutations (TET2/IDH2 or IDH1/2; n=3/21, 14%). No TP53 mutation was detected. Complex karyotypes were observed only when the leukemia occurred.

Characterization of ATG2B and GSKIP Genes Deregulation in Hematological Malignancies To determine the frequency of the deregulation of ATG2B and GSKIP genes in haematological malignancies, particularly AML or CMML, the deregulation of ATG2B (FIGS. 1 and 3) and GSKIP (FIGS. 2 and 3) gene expression were investigated by qRT-PCR in a cohort of monocytes (CD14) from CMML in comparison to normal monocytes from donors. In this study, 29 cases of CMML were used compared to 5 controls and a deregulation was observed in about 30-40% of the cases (FIG. 9).

This pilot study suggests that the deregulation of these genes may be important in the initiation and/or development of sporadic de novo leukemia and will be important to stratify patients and to determine prognosis.

CONCLUSIONS

Whereas the 700 kb germline duplication was observed to predispose to ET occurrence and to rapid progression to MF and AML, none of the affected members of the four identified families developed a polycythemia vera (PV). Patients were characterized by an earlier age of MPN onset than sporadic cases (40 years versus >60 years). Importantly, the spectrum of acquired driver mutations leading to ET included JAK2$^{V617F}$, MPL and CALR mutations as well as triple negative cases, similarly to sporadic ET cases.[25,26] Additional genetic events were detected in this setting, including the combination of a BCR-ABL fusion gene[27], and epigenetic regulator gene mutations affecting TET2, IDH1, IDH2 and ASXL1 when the MPN progressed. The percentage of TET2 mutations (39%) was very high when compared to that described in sporadic ET and other familial clusters of MPN (10-15%).[7,28] The detection of TET2 mutations (including bi-allelic mutations) and IDH1/2 mutations was frequently associated with disease progression to acute leukemia, in agreement with some observations suggesting that, in MPN, the acquisition of a TET2 mutation was predictive of a poor outcome and a high risk of transformation into leukemia.[7,29,30] No mutation of p53 was found in these patients contrary to what was identified in post-MPN AML, suggesting two different pathways for leukemic transformation.

A well-studied chromosomal duplication that predisposes to acute leukemia is the trisomy 21 responsible for Down syndrome. Trisomy 21 predisposes to the acquisition of GATA1 mutations resulting in a short form of the transcription factor, which induces a transient myeloproliferative disorder. In about 25% of the cases, this transient proliferation evolves into megakaryoblastic leukemia through the acquisition of secondary mutations that target cohesin components, epigenetic molecules and signaling pathways, including JAK2 and MPL mutations.[31] There is evidence that trisomy 21, through increasing the proliferation of erythroid and MK progenitors in fetal liver, predisposes to leukemia. This effect has been modeled in iPSCs as mouse models of trisomy 21 failed to fully recapitulate the disease predisposition.[32,33] We also established iPSC clones to explore the consequences of the gene duplication alone or combined with acquired mutations on hematopoiesis, showing that i) the CNV promotes the amplification of hematopoietic progenitors including megakaryocytic through increasing their sensitivity to TPO; ii) consequently induces an increase in the size and ploidy of mature CD41$^+$ MK, iii) cooperates with JAK2$^{V617F}$ to increase the sensitivity of erythroid progenitors to EPO and promote a constitutive activation of signaling pathways, and iv) synergizes with TET2 mutation and JAK2$^{V617F}$ to promote erythroid cell proliferation and amplification. The hypersensitivity of hematopoietic precursors to EPO and TPO was further confirmed in primary cells collected from patients. Like trisomy 21, the identified germline duplication does not induce an overt genetic instability but rather increases the fitness of JAK2$^{V617F}$ by acting synergistically. In agreement, it was observed a similar occurrence of mutations (around 10-15) using iPSC reprogramming between patients or normal donors.[34]

BIBLIOGRAPHIC REFERENCES

1. Song, W. J. et al. Haploinsufficiency of CBFA2 causes familial thrombocytopenia with propensity to develop acute myelogenous leukaemia. *Nature genetics* 23, 166-75 (1999).
2. Smith, M. L., Cavenagh, J. D., Lister, T. A. & Fitzgibbon, J. Mutation of CEBPA in familial acute myeloid leukemia. *The New England journal of medicine* 351, 2403-7 (2004).
3. Hahn, C. N. et al. Heritable GATA2 mutations associated with familial myelodysplastic syndrome and acute myeloid leukemia. *Nature genetics* 43, 1012-7 (2011).
4. Pasquet, M. et al. High frequency of GATA2 mutations in patients with mild chronic neutropenia evolving to MonoMac syndrome, myelodysplasia, and acute myeloid leukemia. *Blood* 121, 822-9 (2013).
5. Bluteau, D. et al. Thrombocytopenia-associated mutations in the ANKRD26 regulatory region induce MAPK hyperactivation. *The Journal of clinical investigation* 124, 580-91 (2014).
6. Bellanne-Chantelot, C. et al. Genetic and clinical implications of the Val617Phe JAK2 mutation in 72 families with myeloproliferative disorders. *Blood* 108, 346-52 (2006).
7. Saint-Martin, C. et al. Analysis of the ten-eleven translocation 2 (TET2) gene infamilial myeloproliferative neoplasms. *Blood* 114, 1628-32 (2009).
8. Yamada, O. et al. Emergence of a BCR-ABL Translocation in a Patient With the JAK2V617F Mutation: Evidence for Secondary Acquisition of BCR-ABL in the JAK2V617F Clone. *Journal of clinical oncology: official journal of the American Society of Clinical Oncology* (2014).
9. Olcaydu, D. et al. The role of the JAK2 GGCC haplotype and the TET2 gene in familial myeloproliferative neoplasms. *Haematologica* 96, 367-74 (2011).
10. Jager, R. et al. Common germline variation at the TERT locus contributes to familial clustering of myeloproliferative neoplasms. *American journal of hematology* (2014).
11. Takahashi, K. et al. Induction of pluripotent stem cells from adult human fibroblasts by defined factors. *Cell* 131, 861-72 (2007).
12. Saliba, J. et al. Heterozygous and homozygous JAK2 (V617F) states modeled by induced pluripotent stem cells from myeloproliferative neoplasm patients. *PloS one* 8, e74257 (2013).
13. Takayama, N. et al. Generation of functional platelets from human embryonic stem cells in vitro via ES-sacs, VEGF-promoted structures that concentrate hematopoietic progenitors. *Blood* 111, 5298-306 (2008).
14. Klimchenko, O. et al. A common bipotent progenitor generates the erythroid and megakaryocyte lineages in embryonic stem cell-derived primitive hematopoiesis. *Blood* 114, 1506-17 (2009).
15. Vodyanik, M. A., Bork, J. A., Thomson, J. A. & Slukvin, II. Human embryonic stem cell-derived CD34+ cells: efficient production in the coculture with OP9 stromal cells and analysis of lymphohematopoietic potential. *Blood* 105, 617-26 (2005).
16. Prchal, J. F. & Axelrad, A. A. Letter: Bone-marrow responses in polycythemia vera. *N Engl J Med* 290, 1382 (1974).
17. James, C. et al. A unique clonal JAK2 mutation leading to constitutive signalling causes polycythaemia vera. *Nature* 434, 1144-8 (2005).
18. Jones, A. V. & Cross, N. C. Inherited predisposition to myeloproliferative neoplasms. *Therapeutic advances in hematology* 4, 237-53 (2013).
19. Harutyunyan, A. S. & Kralovics, R. Role of germline genetic factors in MPN pathogenesis. *Hematology/oncology clinics of North America* 26, 1037-51 (2012).
20. Krepischi, A. C., Pearson, P. L. & Rosenberg, C. Germline copy number variations and cancer predisposition. *Future oncology* 8, 441-50 (2012).
21. Kuiper, R. P., Ligtenberg, M. J., Hoogerbrugge, N. & Geurts van Kessel, A. Germline copy number variation and cancer risk. *Current opinion in genetics & development* 20, 282-9 (2010).
22. Klampfl, T. et al. Genome integrity of myeloproliferative neoplasms in chronic phase and during disease progression. *Blood* 118, 167-76 (2011).
23. Cui, W. et al. Trisomy 14 as a sole chromosome abnormality is associated with older age, a heterogenous group of myeloid neoplasms with dysplasia, and a wide spectrum of disease progression. *Journal of biomedicine & biotechnology* 2010, 365318 (2010).
24. Mancini, M. et al. Trisomy 14 in hematologic diseases. Another non-random abnormality within myeloid proliferative disorders. *Cancer genetics and cytogenetics* 66, 39-42 (1993).
25. Bellanne-Chantelot, C., Jego, P., Lionne-Huyghe, P., Tulliez, M. & Najman, A. The JAK2(V617F) mutation may be present several years before the occurrence of overt myeloproliferative disorders. *Leukemia: official journal of the Leukemia Society of America. Leukemia Research Fund. U.K* 22, 450-1 (2008).
26. Rumi, E. et al. CALR exon 9 mutations are somatically acquired events in familial cases of essential thrombocythemia or primary myelofibrosis. *Blood* 123, 2416-9 (2014).
27. Cabagnols, X., Cayuela, J. M. & Vainchenker, W. A CALR mutation preceding BCRABL1 in an atypical myeloproliferative neoplasm. *The New England journal of medicine* 372, 688-90 (2015).
28. Delhommeau, F. et al. Mutation in TET2 in myeloid cancers. *The New England journal of medicine* 360, 2289-301 (2009).
29. Abdel-Wahab, O. et a. Genetic analysis of transforming events that convert chronic myeloproliferative neoplasms to leukemias. *Cancer research* 70, 447-52 (2010).
30. Lundberg, P. et al. Clonal evolution and clinical correlates of somatic mutations in myeloproliferative neoplasms. *Blood* 123, 2220-8 (2014).
31. Yoshida, K. et al The landscape of somatic mutations in Down syndrome-related myeloid disorders. *Nature genetics* 45, 1293-9 (2013).
32. Chou, S. T. et al. Trisomy 21-associated defects in human primitive hematopoiesis revealed through induced pluripotent stem cells. *Proceedings of the National Academy of Sciences of the United States of America* 109, 17573-8 (2012).
33. Maclean, G. A. et al. Altered hematopoiesis in trisomy 21 as revealed through in vitro differentiation of isogenic human pluripotent cells. *Proceedings of the National Academy of Sciences of the United States of America* 109, 17567-72 (2012).
34. Gore, A. et al. Somatic coding mutations in human induced pluripotent stem cells. *Nature* 471, 63-7 (2011).
35. Genovese, G. et a. Clonal hematopoiesis and blood-cancer risk inferred from blood DNA sequence. *The New England journal of medicine* 371, 2477-87 (2014).

36. Jaiswal, S. et at. Age-related clonal hematopoiesis associated with adverse outcomes. *The New England journal of medicine* 371, 2488-98 (2014).
37. Xie, M. et al. Age-related mutations associated with clonal hematopoietic expansion and malignancies. *Nature medicine* 20, 1472-8 (2014).
38. Lundberg, P. et at. Myeloproliferative neoplasms can be initiated from a single hematopoietic stem cell expressing JAK2-V617F. *The Journal of experimental medicine* 211, 2213-30 (2014).
39. Kishi-Itakura, C., Koyama-Honda, I., Itakura, E. & Mizushima, N. Ultrastructural analysis of autophagosome organization using mammalian autophagy-deficient cells. *Journal of cell science* 127, 4089-102 (2014).
40. Kang, M. R. et al. Frameshift mutations of autophagy-related genes ATG2B, ATG5, ATG9B and ATG12 in gastric and colorectal cancers with microsatellite instability. *The Journal of pathology* 217, 702-6 (2009).
41. Mortensen, M., Watson, A. S. & Simon, A. K. Lack of autophagy in the hematopoietic system leads to loss of hematopoietic stem cell function and dysregulated myeloid proliferation. *Autophagy* 7, 1069-70 (2011).
42. Warr, M. R. et al. FOXO3A directs a protective autophagy program in haematopoietic stem cells. *Nature* 494, 323-7 (2013).
43. Chou, H. Y. et al. GSKIP is homologous to the Axin GSK3beta interaction domain and functions as a negative regulator of GSK3beta. *Biochemistry* 45, 11379-89 (2006).
44. Lin, C. C. et al. GSKIP, an inhibitor of GSK3beta, mediates the N-cadherin/betacatenin pool in the differentiation of SH-SY5Y cells. *Journal of cellular biochemistry* 108, 1325-36 (2009).
45. Li, D., August, S. & Woulfe, D. S. GSK3beta is a negative regulator of platelet function and thrombosis. *Blood* 111, 3522-30 (2008).
46. Soda, M., Willert, K., Kaushansky, K. & Geddis, A. E. Inhibition of GSK-3beta promotes survival and proliferation of megakaryocytic cells through a betacatenin-independent pathway. *Cellular signalling* 20, 2317-23 (2008).
47. Abrahamsson, A. E. et al. Glycogen synthase kinase 3beta missplicing contributes to leukemia stem cell generation. *Proceedings of the National Academy of Sciences of the United States of America* 106, 3925-9 (2009).
48. Tefferi, A. et al. Proposals and rationale for revision of the World Health Organization diagnostic criteria for polycythemia vera, essential thrombocythemia, and primary myelofibrosis: recommendations from an ad hoc international expert panel. *Blood* 110, 1092-7 (2007).
49. Malak, S., Labopin, M., Saint-Martin, C., Bellanne-Chantelot, C. & Najman, A. Long term follow up of 93 families with myeloproliferative neoplasms: life expectancy and implications of JAK2V617F in the occurrence of complications. *Blood cells, molecules & diseases* 49, 170-6 (2012).
50. Mali, P. et al. Improved efficiency and pace of generating induced pluripotent stem cells from human adult and fetal fibroblasts. *Stem cells* 26, 1998-2005 (2008).
51. Debili, N. et al. Characterization of a bipotent erythro-megakaryocytic progenitor in human bone marrow. *Blood* 88, 1284-96 (1996).
52. Livak, K. J. & Schmittgen, T. D. Analysis of relative gene expression data using realtime quantitative PCR and the 2(-Delta Delta CT) Method. *Methods* 25, 402-8 (2001).
53. Cabagnols, X. et al. Differential association of calreticulin type 1 and type 2 mutations with myelofibrosis and essential thrombocytemia: relevance for disease evolution. *Leukemia* 29, 249-52 (2015).
54. Plo, 1. et al. JAK2 stimulates homologous recombination and genetic instability: potential implication in the heterogeneity of myeloproliferative disorders. *Blood* 112, 1402-12 (2008).
55. Quinlan, A. R. et al. Genome sequencing of mouse induced pluripotent stem cells reveals retroelement stability and infrequent DNA rearrangement during reprogramming. *Cell Stem Cell* 9, 366-73 (2011).

SEQUENCE LISTING (48 sequences)

SEQ ID NO: 1 - DNA, 694026 bp, homo sapiens
  misc_feature: complete CNV region
aagctagaattaagactcataagaaaactaaccaaaattggcagcagcagatatggacaggaggagagaggaagcacaaggatgctgtttcctcatccttcacaggggacagttgggagaggtcgtagaacaataaacagaacggccacataaaagctctaaaaggccgggcgtggtggctacatgcctgtaatcccagcactttgggaggctgaggccggtgaatcatttgaggtcaggagttcgagaccagcctggcccacacggtgaaaccccgtctctaataagaatacaaaaattagccgggcggtcgtagcgcacgcctgtaatcccagttactcgggaggctgaggcaggggaatcgcttgagcctgggaggcggaaattgcagtgaggtgagatcacgcccctacactccagtctgggtgacagagtgagaccctgtctcagaaaaatgataaaagctctacaggtgcaattcagaccttctgaattacgtaagaaaaacaaccttcccaaaatatatttgaaccagtaagagaattcaacaagttaagtgtttatacatttaacatgtaacacccaacagttttcttgtatatagacatgagtcagttagaaaaaaaaaatgggtgatcaatgtaaaatacttatatgaagcaaattttaaaattctgaaggacagtaaacaagtcttgaataaacctaaaaatcttaaaatagtcatgtgaattggacaatttacctctatgcctcagtttcctcatctgtaatacagggacagtaaaagtagccatctcatgggctgttgtgcagattaacatatcgggctaagttagtatttgtaaagctcttagtggtacatagggctatggaaaagcattgtctaaatcaatcggaggcttcgttgttgcaaagatataatatctccctaagcctatttataaatgtaatgcaatcacaacaaagaacttaagagttttgtacctggacaatttgaacctcaaattgatatggagaatttaagatgtgagaaaagctgggaaaaatctgaacgaggagagctgtgagggtggactagagttagcagccatcaacaagcaacccaaagctgcagcaacaaaccctggtgggtagtcacgcaggtgcaggcatcaagagaagtgaaaacggaagaggctgagggagagctgaaaacacaagtgggaattcagcacacgagtgaaggcaggtacaacatgccactctggtataacgattttgtgctaataatggcccttgataaacaacagatgcacgaagggcactctgccttctcctttctcttcctgaaagcaagagagaaacctccacgtggaagattcctccatcagaaggaaagtgacactcatcactggggctgggagttgaggctgagagaattctgtataaactaacatcataaatgaacctttctcctttagccacaaggaatttgcctagcccgaggcccctttcctggtcacattttccacaatatactactctttgtccaaaatcagtgtttaactctgtttctttgggtctttgtttccttatgaggggctcctgtgtcacagaaaacttacattaaatcaatatgcttttctcctatgaatctgttttatgtcaatttaattctctagcccagctgaaaatgctaagagggtagaggtgaaattttgcctcccttacacaatcaaggtggcatttcaaagcactgccaaaggatacattagtcactaaacagcatcattgagacctggctagccatttgcataaaaaagttggatcactacttcatttctcatatagaagtaaattccagatagattcatgatttaaacaaaggaaatgacaaaaggatagatgaaaacatgaagaaaatttattgtggagcagagaagtccttattaagaaaaacctgggccgggtgcagtggctcacgcctgtaatcccagcctttgggaggccaaggcaggcggatcacgaggtcaggagatcgagaccatcctggccaacatggtgaaaccccgtctctactaaaaatacaaaaaattagctgggcgtggtggcaggtgcctgtaatcccagctactcgggaggctgaggcaggagaatcgcttgaacccaggaggcggagcttgcagtgagccgagattataccactgcaccccagcctggagacagagcaagactccatctcaaaaataaaaaaggaaaaaaaaaaaaaaaaagaaaaacctaaacccagaatacacacaaaaaaagcaatacatatgacagtgttaaaaaataaaacatttctgcctagcagaaacaacaacaacaaaataaagtacaaaacaacttaaccatggtgaaaacacagatcagtatgtagagaaacactgacaaaggacttctttcctgaatgtctaaagattcttcatggctgtttccacacttcattcatccctcaccagcttagattctgtgttccaaaaactccttcacacacatgggagactgtctgccccactcttgtgtatcacttgccaggtgaaatgccacatttggtggaacccactttgccttattttctaaacctgagagaaaaatattgatagacaaaatactcataaaaacaggctgacaatttccactttgaattcctgcctgcaaacctcaaaaggccagatctgctcagcaattctatcaagtttctctggtaagttggtttcccctggatcgaagatggctgtgtcagtctatctgttctcatatgtgcgatgtccttgccttatacgtggctgaaaaagagacctaatatggggaattcccagaggggccttgcctgaagggcccacacaaagctcttcctgccttcctgatcactctgctcggtttctttccatcatgggacttccttctgtgctagaatgcatacccccctgaacctagctcagggccaaagattgagctgaataaacaaataccagaagggagaaacagggcagattctggcaacatccgaaccacaccacttaaactaacttggggcaagtaacttctagtctcagagcctgtttcttcaccaagaacttgggggtaacaagagtacttacttcttcgtaaggcctaaaggagataatctgtgttaatcacacatcacactagctggtccactggaatcactttttggaccaactgcctttctctctctctctttttttagctttccttctttattaaattcccttaagcattactcataattcaagtttaagacagaacaaatctcacaaaggatttatggctagttctcttcttcttataaatgaacccataaaaaagcatcccctaattcctctctagtttttctaacctccttgcttttctaaaattgaaaaaaaaaattctggtgtactaaaaccagaaccaagtttcctcaacgtcttcagttaaactacctttaattcctcaatcaaggcataccacacaatgttatctacactttgcagtaaaggactctgagtggctggtgttttttgcttagtgtaaccattacacaacagtatgtacttgtcacccctggcctcctaaaaaaaatccagaatttattatcttgaccttaggtgccaaatgaggctggcaaggctttctcctggggtaagatcgtaggtggttaggagtaaataaaaccccagctttgtgactctgtatgacatcacacactttcagcctagcattgccaactactaggcacattaccctgagcttcttgtaacaaaggtagtgatgttcattttaaaaatatcaagaaacagattaataaaattcagaatatggtatgtacaaatccatctttacgaaagggttttctagaatttcaggagaaaaaatgcataatatacacattttattcttttccttatatatacaaagacctttgttataagtaattacaaagctaacgatacagttttacttcaggtttagtttttcctgctgtgacattagcatttgactacattcattctgagagagcctgaagcaaaggtaggtgggggtgcttgtcaccctgttgaacagttgcccaagaaagtagagatgttgaaaaaaggcagttgtaacttggagcaaaaatcgacctaattatttgtgattatatgccatattttttaaggtgagcgtctcaagccaattgtttgattttttaaaaatcgagcaaattgtgttattcttgcaacattcttgatctcttcagttgcagaccagtagtaattccttctctcccgcttaaattatatgataaagatgaaaggacagacgctgacatttagtttgtctctcagtgctttctgtgatcttttttcaaagtaaaataatcttaggaaaggttttaattttttcctcctaagaacacaatgatgcttttcactgaatgtggacaatatcataaaggaggaatgttgaaatttatggaatccactatatggcagatactttccatctgttacttgctttaaaactaaaatccaggccgggcgcggtggctcacgtctgtaatcccagcactgtgggaggccgaggtgggcggatcacgaggtcaggagatcgagaccatcctggctaacacggtgaaaccccatctctactaaaaataacaaaaaaattagccgggcgtggtggtgggcgcgcctgtagtcccagctactcgggaggctgaggcaggagaatggcgtgaacccgggaggcggagcttgcagtgagccgatatcgcgccactgcactccagcctgggcgacaggggagactccgtctcaaaaacaaaaacaaaaacaacccaaaagccaacaccatcacaacccaatggtggttcattttgcctgctgccctgaaaaaatgcaacagtagcaggtgttgcagggccagttgagtgagaagagggagaaatttctcgaacccatctccctttttggcctctgaccttttagttgaaacaaaattagttacctatagacttaagtgaacgctatactgcacgtaggcacataaccccaacctatataagcactaagaaaattgcaacactttgagttggtctggtggaattatctccagccttctccctgtatccggttatagcaataaattcccttctttcctagattatctgcttctcattattgggctatgcgaaaacacagccgacctggcccagttccaggaacaacattgacatggtgttaaatccagagaagatagccccaagttagagaacaaagttgctctgcataataaagtaagaatgttggtgtttcaaggattacctctgtaaagggaggaggagggtgcggtctgtgaggcagagaggacttgagaaaagatgcaggtggtggggctttactggggtggtggtaatgctgtaacaatgcttaagggtctttttcaaaacaaagtttctaatatcccactttaagctgtagtctgaatgttaacccccacccctccctaaacccccaaacttaacccccaaacttaacccccaatgtatccccaaaggctgacatcggcagccctgtggagaaagaatcagagtagtgttcactgtagggtagggtgatgtgcgtggaacaagaataggatcagccataaaccaaacggaatcagtggatgttagagctcaaagtaaggggtgatggggagaaacgtaagaccccattgaaatccttggagagattgtgaaaggtgatgtgggagggagagtcaagctaaattaagtcgaaaaagatggagtgccccatccgacatatagatatagggagcacagggcatttcacaatgaaccagatgggattataaaactatggtcagtctattattcttatacaagataggctaaatatgtgtgagtctctcttaaaatgaagctttactgtggttacacatgacctccaagttgtggggatgagtagaaatgagacactgtgttacttaactcactacagtccagccagtaagatgataaagtggctatggttcttgctgtccttgcttagtgagctgatagggccagtgttgaggagaggcaccaccaggtcagaacagccctggccatgttcagcctttgggggccttctaagtccaggggcccaagtaattggcatcttaaccagtgaacctgctgtgtaagtaagtcccgtactactgcaccaggtaccaacattgaatttataagttttagtattgagtagtacaaagagctctcccatattattaaaatgtgtttagtagtttcaagagctatagaattttcgcctcaaactataaatgatcattatagttaagtatttgtgagagaattttcttgcaaaatttctcacttaaatttgtaagttgtatttgctgtaggaggttcactgacaataaattcattgaactagctcaagttaactcacttgatatacaaaaaggttagaatctttgagaactggtgtatttccgcaggcatttcctcactgtgaataaagttgttttgtaagcaaaatacagtgacagtaacaaagtaactttaaaacacaataagattcagggcaagatgctgacagtggcattgtttttcagtttcccaattctcctcacaaagtccagaagagcaaccaggagagcaaaagaaaaactgagtatagaaaagtaggaaaaaaaaatcagaataaaaagatggagagaattgaagagaaagtgatggatataacaggcaacgaagatgcaacatatccataacagaagtcttacccccagaccccctcaaagaggaaagtaaggcagtgggtagaaactactaaagaaaacattgctgaagacaaaaaagatgacttgaacctgtgtacctgaagggaacatgatgtgcctagaacatataaacaaaaacagtcgactccaagacatagccttaaaattattgtacgttatagaacagaaatctgtttggcataagataaaatgaccaagtaacttacatgggattagatcttcacagaagacttttaagttaaaaacacagtggagtaaatggagtaacgtagtacaaatacccaagaaaagaaatgtaacaccctccccacttcgggatttttaaattcagccaaatgaccttcaagtagaaagaccatagacaaacctcaatgaagaggaaggaaggaatcaggaaatgatgttcctgtgagcactccctgagtaatccactaagctatgagcttcacacaatcaagaaatgtttaggaagcttttcattaggactagtggtgagaaatgaatatgtttaactgaagaactaagactaaataaagggcacgagtgtgagaaatcctatgtgtttgttacattctctgataataaaggtatatttcagttatcaaaaatgggataaaagggagagaatataccaaaagcaagcttgatggctgccttggaggtatcacttagcacttaaagaatattactttagatgctttggagagagagaggggtgggggaaggaaatgttagtggtttcaattctgctcacagtagggaatcaaaagacgtgcaccacccaacaggttggccaccagtcacatgtggctgtttaaatttaattaatattgaataaaattttaaattaagtttctcaattatactagccatatttcaagtgctccatagtcacagaagctagtggctaccacattgggcgacacagattcagaacatgtccagtattatagaaagttctttggacagtgctacagtagatagtatttttaaaggaaaggctggtcaggtacagttgttcatgcctgtaactctggcactttgagaggctgaagtgggaggattgcttgagcccaggagttcaagaccagtctggacaatatagtgagacctcatctctacaaaaaatttaaaaaattagccaggcatggtggcactcatctgtagtcccagctactcaggaggcagaggtgggaggttcgcttgagcctgggaagtagaggttgtagtgagctgagatcgcaccactgcactccagcctgggcgacagtgtgagacgcggtctccaaagaaaaaaaaagtaaaagaaaagaaagaaaaaaagaagggctgaggaaactaccctaagatattagtctaaaggtatgaaatgaaaatgcaacatgaagagaatactaaaaaagaatgtagaaaacagtccccatagagaaaaattgtatatgtatataaaaacaaacataaaacaatactaagaccagtacatcagatacatcaataactgaaatgagcttaattcactaattcaaaaaaatgcatcaaaatccaacctttttatacacatgcacacatatacgaatgaacatgcctaaaacaaagagattcagaaagatttaaataagatgctacgcacaaatatgccagacaaatgcaaattagtagaaacaaatagacacagttcatgatcttcatatctgacaaggtagaaatctagccagaaatcactcaaagaaaggatagttcattgagccaaaggctacacaagatataacaatcaacatttatgtggccggtaacacagcaacaactttatgaagcataaactaccagagattaaaggagaagatggaaatatactaataggagacattagtgtatttttttcaggatgagatagaacaaatgaacaacaataatgatggggaacacagaaaacctaagccatattaataataaagcagagatttatatctctgaacttagttgagagaaatgcctccttttcaaatgtacagggaacaatcatgaaaactgaggacatccgtgtgcatttgatatataggcataatttacacagcccaatatgtttatttattttaattttattatttttatttattaatttaattttatttaattttacttatttttcatttatcttttatttatttatttatttatttatttagacagggtctcactctgttgcccgggctggagtgtagtggtgtgctcttggctcactgcaactttgcctcctgggctcaagcgattctcccacctccgcctcctgagtagctgggattagaggtgtgtgccaccatgactggctaatttttgtattttagtagagatggggtttcaccacgttggccaggctggtctcaagctcctgacttcaaatgagccgcctgcctcggcctcccaaagtgctgggattacaagcatgagccactgctcccggcctttttatctatctatctatctgtctgtctgtctatctatctgtctgtctgtctgtctgtctgtctgtctgtctatctatctatctatctatctaccttagagatgagttctcaacatcttgcccaggctttgacaggcagaggtggggggatcacttgagtgcaagagttcaaaagtagcctgagtaacatggtgaaaccctatttctaataatgatatttttaaattaaaaaataaaataaaatttctagtattaaaaagttatatatgataccaaaatcagacaaagacatcacaagagaaaactacagaccaatacttcttatgaatacagatataaaaacccttaacaaaatactagcaaaccaaatccaacagcatataaaaaagattatacactaggacccagtaaaattcatcccagaaatgcaaaatggttcaacataccaaaaaaaaaatgagtgtattacaccatatcaatacaataaaggacaaaaaccaacattccaatagatgatcatctcaacagatgcagaaaaaacatttgaaaaaatctaacatccctgcatgaaaaaaacacactcaataaactgagactagaagggaacttcctcaatctgataaaggacatttatgaaaaagccatacctaatatcagacttaatggtgaaagatgaagatttctaagatcaggaccaaggcaaggatgtccactctcactctttctttctttctttttttttgagatggagccttgctctgttgcccaggctggagtgcagtggtacaatcttggctcactgcaacctccgcctcccgggttcaagcgattctccggcctcagcctcccaagtagctgggattataggcacccgccaccacgcccagctaatttttgtgtttttagtagagatgggggtttcaccaagttggccaggctggtctcaaactcctgacctcagatgatccacccatctcagcctcccaaagtgctgggattacaggcatgagccaccgtgcccggcccactctcactatttctattcaacacagttctagaggttctagccagggtaattaggcaagaagacaaaagaaaaatcatccagattggaacagaataagtaaaataaatatcacatcatacttgtgaggatggccattatcaaaaaaccagaaaacaacaaatgctggtgaggctgtggcaaacccttgtgcacagttggtaggaatgtaaaatgttgtaactgttatggaaaacagtatggatgctcttcaaaaaattaaaaacagaactaccatatggctcagcaatccaactggcaggtattcacctaaaagaattaggaaacagaatcttgaactgatatttgcgtgcccatattcatggcagcaccatccataatagcgaagaggtggaaaccaccttctatccaccggtggatgaatgaatgaggaaatggtggtgcatacatacaatgaaacttcatgcagccttagaaaagaaggaagtcctgccatatggttgagcctggaggacatcacgctaggtgaaataaatcagtcacagaaggacaaatactgcatgattcctacttagatgaggaagctaaagttgtaaaagtcatagaagtggaaagaagggtagcagtttccaggagctgggaaagaggaggcgatgaagagttgctctttaaagggcacagggttttagtgatgcaggatgaaaaagttctagagatctactgtacaacaatgttcatataattaataatactgtactgcacacttaaaagtctgttatgagggcagatttcatgttagtttttttgtttgcttttttttgttcagaaagggtcttgctttgtcacccaggctggagtgcagtggcaggaacacggctcactgcatccttgacttcccaggctcaagcgatcctcctgcctcagccccacaagtagctgacactacaggtatataccaccacgccaggctaattagattttttttatcataataaaaaaagagtaaacttaggaatcaatttaacaaaagaaatgcaaaacctatactcggaaaactgcaacatgttattgaaagaaattaaagaaaatataaatatatatgtaataaaatatgtagagggaggctgggcacggtggctcacgcctgtaatcccagcactttgtgaggccaaggcgggcagatcacctgaggtcaggagttcaagaccagcctgaccaacatggtgaaaccctgtctctactaaaaatacaaaaaattagccgggcatggtagtggatgcctgtagtcccagctacttgggaggcggaggcaagagaatcgcttgaacctgggaggtggaggttgcagtgagctaagaccgccattgcactccagcctgggcaacaacagtgaaactccacctcaaaaaaaaaaaaaaaaaaaaaaaaaaaaatatatatatatatatatatatatatatatggagggaaaaatatgaggtatttagaatacattggcaaaacaactttgtgtttccagccaaaaccctagagtcagtcttgtggaaaactgagattctgcattgcatttagttaatttattagggctatttattcttacaaaacagcatttctttttgtaagaagtaatccttttgctatgtttttaatttccacagcaaattaaatctgcacagcacttgccatcccctcttcctaagaatctagctccctctttttcaaggcccaatcttaaatgccatatccacagacaggaatttccttgccagccaatcgaactccctaccattaccctattctattttcttctgggattttgcaccttctttttatctttttccagaactaaggctgcatgagaatggggccttcaccttgtccctgctgagtcccagttcctggcaccgttcatggtgatggtcaaatatttggtcaacaaaagaatctcgcacaaaagctttcctctttctgggtccccgcgttcctattcgtaaaatgaggcagctgcctgatctcccatggtccccctgctctgactttccacgatccagccctgctgagaggcacctgtacagtaattgctcccacagaccaaactcccctgctgccatggtctgtgcagggtgaccgggttacaacagaagatacaaaccctggcacgtcggacgtcagtgcttcttctctgtctagtgctggttaagaaacctgggttcagagactgtaaagcgggagaagtagtgtttttcttatacaattctcttaaagcccttcagttatatatcccgctgaatcctcagaacaaccctctaagttcatctctgtgacaagaaagctgtggactagagacacagggaagtgggaaggccaggattcgacacaggatggattcccttctctggaaggcatcccctggtaatatctgaggtccagctactgtctatagaggtacaggaggggcagcagggtcttgagaagggagcaagaggacagggcacagggtgggatctgctgtgactgcaggtcatgggaggtggggaagggagtctgcttggggcctgagtggtcagggacagcttcaggcaggaggggcttctgctgggattgtgagcagagaggatagaagttatctgtgcaaggacagagcctggtgaatgcccaggtaaggaggaggcagagctggctggggccgagggcacatgggaatgaggagggtaaggagggcaggaccagatggaggcagggggggctctggaataccgggcattgccaacaacatttttgaggttgcttactccaatggttctcaacgtatgcctccaagaacactggggttttaagcattggattacacggggaaaaaattgtagtcccttatctccaaaggaaaataaataaatccatgaatattttttatttgggggctgcctattctcacttctctccaccagaatctaagtcaaggatagaagctgattccgcacgaagttagataaactatcttgcatttaatcaatcattacaaaaagtattcatgccacatacaactttgtaacacccaggtgcgtgaccatctataaaaggggggaaacccaacctctatcccttttccacgtgggcaagccaagggttctgagggctcatccacagggctcgccggcctggcctcctgctgcgtcccgggatgtggaccactgacccagaggcttctgagtcctgagcacagataagggctcctttcaggcctttccttgagctgcacgtgaacctgtgtgggcaggcagcgtttgcaggcgtgtttacgggcaggcagcgtttgcaggcgtgtttaccggcaggcagcgtttgcaggcgtgtttacatgcaggcgtagcaccatgtgagaccactggtccagggtttcagaggtcctgctcaggtgaatcggctgtgttctcacaagttcacggagctgagtgggtgtgcaacatgaaatactagtgctgtgagggacagaagggacagaaagaggctgaagaccatcatccagctgagaaaagccgaggcacaggtatagctgggcacctggaagaagctctgccaaatggaatcctccttggcaggagtggtagtgctaaggcgagcagagtgggctacaggcaggtcctgcaggccctgggtagagctcatcctctgtctgtccattcctcccagaccccagcgtggtggagaagacacaggcatagtaaacgaaggtgaacagaaacacaacatccccattgtaggctggccaggctcaggccctggggtgaaaggagacaggtgctgccaagacctggagaaggacaaaagaagacagaatcaagggtgaaggaaaggaccaggcagtggcgaggggtggtgctgctggagcaggtctaagtgggaagcctagtggtcagggatggcccccagaggccttctgagccaaggcaaattctgacacctgggtctgtaatctgaagatgtcactatacttcaactcatttctgagttttgtactcttatttcctcaaaactcaatagcgtatctaatatctggctcagctgatataatcaagcaccagtgcttatttaataaagcaatggtaaggccggacgtggtggctcatgcctgtaatcccagcactttgggaggccgaggcgggcagatcatgaggtcaggagatcgagaccatcctggctaacacggtgaaaccccgtctctactaaaaaaaaaaaaaaaaaaaaaaaattagccaggtgtggtggcgggcgcctgtagtcccagctactccgagggctgaggcaggagaatggtgtgaacccgggaggcagagcttgcagtgagctgagattgcaccactacactctagcctgggccacagagccagactcatctcaaaaaaaaaaaaaagcaatggtaaatgaaagtgccagctgaaacttgtgaagtactttatagatatgagcagctgcgataaagggggctgcctacaaagcccttggctcccgaagtggtaagggagacatgagtgcctccaggaagcctctcccatccctagggaccctcagatggcagcagtcggggaggggttagcactgccttcatggagaaggggtggtctttctttctgatacagccactgtggactaagaggggtcaggctccagtggagctcaccatacatcagtcatctggcagcagctcgagaagcatgtcctccacgccgtcaatctgagaggcagagagagagagaaggcattgatcggccagagccctccactccctccattcctcactcctgcgccttcccctagctggaaacagcaggtaggaacccaggtgtgaggatttcaggggctcttggagactgcccctcctcccaccagccttcagcctgtgactgcccaccagagatgtcttcctgcggctagctggtggctgggaggaagtggaggtagggttctgttagagacctcagaggatctatcttctctctggtaaagtcctttagaaatctgcacttgtacatttcccccattttttaatgcttttgggactgggatggagggaagataaaccactaaggccagacatggaggagggcaaacccaagatcacccgatggacctctgggagaaagacactcaccttgatgtggtacactaagcgccagaaactggagtctgaggatcggtatcgtccatcagggtagagctgccacatgataggcagcaggcttgggcctatctgggtgggggtcataggcctccccaggacgacgtcttcccgacgcaagagcacccgtaactgtaacctatcctttatctgaggagaagaaaaggacagggcatactttcaggttccgcttgccagggcttctccaggcgcagaaaaccggaatccctcctgccagccatccacccatctgggcaggggtccgagtgtgaaatgatggtcatcactgttccctgaagctcacttccttaggccatgcatgctcctctcagggactctggctgggccaggaccaccagcacacacacgtgtctagccacccagacagggccatgaaaggcacacttttttctggcgggttgcagcggctcacacttgtaattccagtgctttggaaggcagaggcaggaggatcgcttgaggccaggagtttaagaccagcctgggtcacagagcgagaccctgtatctacaggaaaaaaaaaaaacaacaaagaaagaaagagagaaaaagaatactggccttttcaatgatgtgaggcaaaatctgtcccacagtttgctagtgggttattttttgtggagcatgtatcatgattttatgaaaaactgtctggttcgtggttttggtgtcacgttgaagaagagatttctcagagatttaaaaaaagaaatccactgaatcttcaaattatttcttcaaattttgattttaaaaaagtaagtatttaacttgatttttaaagtaaaaacatatttaaaaaattgaaatgccaataaaaatgcagattttgtggtggttaagagcctagaattccaaccccattacctactagcaatcttacctcggacaaatgtacatttttgtgcctcagtttcccatctgtagagacacagtcaacactcaataatttttgattgctactggacatacgtgttctaatatattttttaatttttatgctttcttcagtgtatgtttggagagagtttgaacattttttgactctttttcattgagtaaatccaaatacttgtaaaagacttatctatttctttaacaaaaacttaacatggattaaggacccatcttaaggcatcacacattaaaaaagtcaatattgattcaataccggcgcttatactacgacatcacttgttaaatttgttttctaaataaagcccagaggtagtggaaaatacttcacactctaggccagtgtttgctatgcctggttgaccctaaactgttgagggttctttttaaaaatacagatttctgggacccacctgagatgattccgataatcggccatatggatgagtcacttagagatacccatttttaaggattaggaccccgaagcccagaaaatgcctgctgtagtcaacattatagtcacactccacaggcactgggtccacccctttgaccgacattcctttgcggttttcccacccttcttccctgcctggagaactcctattcatcctccagagcccggctcaaagtggcttcatctgtggggatcctccctgccccatagtgagtgctccttgagtcctcgcccttcctagggcatcccaagctcccaggggctgcccctgctgcctcgccatccgctccaaagctggctgtacctcgatggttaagggcagccaggcgtgctgcttctcgtccaaatacacgaacttctcccaggcccacaggcggtccgggtggtcggtgactgcctccccgagtgtcgggcactcggccatggcgtcctcgggccgcctaagaagcaagagccagagcctctcaaggccgctcgctggtccctgggatgtggggccgaccctttatatccgggcagcatgcggccgccaccaagcggcggggcgggaggacggccttggggcgggaccccgggtcgggagaacgaccttggggcggggcgtaaggcaggatggggcggggtttgtgggggtcttggtggcaagtgagggtcccgcgcaggcgctacgtcccggcctgacttgctccctggaacggtggcagctcctgggaacgcagacccggccccagctggcccgcgccttcctcgaggccccggccagcagcgacaccgaccgccgccctctgctgctgctggagaggcaccggggtgaccttggccctttcttcttctggaagacccccccgcttccctcggctgccggaccgggactctgggcctctgctgggaactcacagtcgacaccaggatgcccagagccaggacccactcctcatcttatgggatcagaagagacccgcgcgggcctgagttaggcctgggctttcccgggttccctggatctccaccagcctgtgcctttgagtgtcagagtacgttttttggcaaaggacaactcctgacgctccctctccctcttccatacacaaagcatgcgttttccacaggtctgatgtgctgtggacatctaatagctattacaaaatggagaatcatgggtttttgcccttgggctttgagtttactagtgaaagcatagttcgaaatgaatacttaaaaagaaatccctccttccaccctaagatcaatggatttgaaaagtgcctggtttatatgatcaaaaccacccctctgtaaattacaagcaataaggaaaacaatttcactttattttgcagtaacgcattcccactaaggcaattaagaaagtcatgcacaatgaaaaacatgtgaaaccagctccagcctggttcaaacatcaccatgggatggagtttggtgtctcatcttccagctctttcccagttctctgaccaggcactaagaacataatttgtgatcctttgaaatatcaccaaagtggaaattaagagatctgatgaggacatctgattcacctggcagctgggtatctgcctctttgcctatccagagagcctaattcccaagaaggggctgagagggcctaaggtagtcgagacataatgggatttaccaggaacacaacatagaagagaaaagccaagggaagttgggggtggagtgagggcccttgagctcagcaaacctcttttccactgtagcccttagtggtgttaatatttaatatgcaaacttaaaggtttcatgctgattttcctgtgaatggctcttgactccagacctagatagccacagagcaagatgacaagctcgctaataagctctgttggggaggtctcagcccaggccagagctgtgaagtgagaaataagtccagtttaaatagtgctgctgggatggacttttgtggccagggaaggggtacccaggagccagtgtggccactgacccagcctcatcaatggccctaggatccagaatgccacaaacaatggagcaagaatcagatctgtgtgtctgggtaagcagaatgttctgagaatataattcctttttccttcttttgtaagaacaatttatttcttcagttttgcatgagggcttcttaatattgagcaagaatatacatcattattgcgtgagatttagaaaattatttgagagagggttccaataaatgaaaatgaattaaggatgtctgtggagttcattgggcaacttatagagcccttgagcttttttaagtgaacattccacaagaggggaaacagtagctattgcatagtctcagagctgtctctgagcctccgtggcatgttatctgccccatctaagggttataaaggccataagcctagctttagaattttatgttcctttccaagtctttgttagtctgatttccctgaggataagcaaatggatgtttcacacagaaagctacaggaagcaatcattttgacagaatccttaatggatgcgttcatgtcctgatttagatctagttttgcctttaccacgatcacctgtgaacttgacaaatcctttgcaacttggcctcagtgccatagttttgtaatgaatggggcaaaatacctgctctctaagcttgtttctaactcagtaggccccaatcctcctataacattgcctagtgggaggagggaatagttaagaaaagagatggacaaaatatatgatgttagttcaggaatgcctacagtttttggtacagtggctgtagatcaaggaccccagtggaattcatgggagccattcttcttgtttgggttccaaagaaggggttgaggagtagtcaaggccatcaggatgaccttgactcaaagtgttgtccctggaccagctacagtagcatcacctggagctcgtaagaatgacagaatctggagcctcccccaagactactgagtcagaatctgtattggaacaagacccccaggtgattcacgggcatggtaaatgttgggctatatggagggagggtcaagagggagagatagggggtgtctgattcaacacaccagtgccctccagatttctccaactatgacacaggacttatatcggtgtttgtgtatcatttacttccaggctatcttattttctgccaaaatcacctctaatatatagagtgttttcctcttaaaagaaaatcctagtaaccaaggtcatcctcaccaaccctggggtccttgattgtcaatgattatagcaagctggaaagagcctatttagaggctacttaggtgtttaggcctttgggccctatgatgactgagcctaaaccactaagaatcacctgggaagctttaatgaaacacctgcgcctggatcccactccaaaccaattacatcagaatctccgagattgaggcttgagaaaagtaggtgatgctaacacgtaggcagggttaagtacaatttctctaagatctgagtgactgtttttgacgtgtgcacagatttataaatctaaataactacgaaaatgtcaaagctattctttctaccatcaattctcattgtaaacttcaccccaactccatattttacttctttccctttgccctactttgctgcttccaatccttcgtggtcagggatccatagccctaagtttattggaatcataagggtctgagatcttgctaatgtgtaaaacacagaatctgtgatatatatgtagctattaaggcatccatgcctggagtgttttgtttgtttgtttgttttttgagacagagtttccctcttgttgcccaggctggaatgcaatggtgtgatcttggctcactgcgacctccacctcctgggttcaagcgattctcctgcttctgcctcccgagtagctgggattacaggtatgcgccaccacgcctgtctaattttgtatttttagtagaaatggggtttcttcatgttggtcaggctggtcttgaactcctgacctcaggtgatcctcccacctcggccttccaaagtgctgggattacaggcatgagccaccgtgcccagcctgtttttttttttgtttttttttttttttttttagttcctaggtctgggccatagttgaaataattaaggctgctgatcaagtgagttcagggtacaaaagatgttgtagcctttactcataagggatgaaatggtatctctaaattaatggagaatctgagacaaggatatttcaagtagaaattagggactgatcctactctgcccactacatagctatcatctctctctttaaaattaacagttctaaggaacttaaagcttctccaactttaaggtgtatatggagattttatttaaatacagattctaatatggtagggttgaggcgattctcaagattctgaatttgtaacatattcatatcctcggagttgatacaggtactaatggtctataaatcacctctgggtggcaaggacctatactaacccccatgctacccttgatacccacacaaaacacaaatgaaaaacacaactcacaacccctactcaaaatgcagcgaatagttgattctgccaagctagcgagtgaccaagatgtgatagaattgcactggacactttgagctacaactgtggttgccatttgccagaggcaagttaaaattgacctacatttgtactggaaacatttctcaatcctgggattactccacaccttgggtgttactgtcctactgatgctatgatgcctacagctttgtttttgtttttctgttttgttcaaaaatgttttagctattcagaccttttgtggttccatatgaattttaggattattttttctgttaatgtgaaagtgttgttggaattttggtagggattgcgttgaatatgtaggttgctttgagtgggatgaacattttaataattttaattccttcaatctatgaacatgagatattgttccattcgtttgtgtcttcttcagtttctgtcatgggtattttgtagttttgcgtgttcagatctttcacctcattgcttacatttattcctaagtattttattattttttgtagctattgtgaatgggatttttaaaatttctttttcacatagctcattattagtgtatagaaatgttactgatttttgtatgttggtttttgtatcctgcagttttactgaattcatttatcagttcgaacagcttttggatggaatctttaggagttttctatacatacaagatcatgtcctctacaaaccgagacaatttaacttcttccttttcatttggatgccttttctttcttttacctgttgctctgattaggatttccagttctgtgctgattagaagcagtgagagtgagcatccttctcttgttcctgatcttagagaaaaagccttaaactttttactattcagtatgacattagctgtggacttgtcatatatgcttcattgtactgaggtacattccttctagacctaatttgtcgagagtttttaccttgaaaggatattcagttttgtcaaatgccttttctgcatctattgagatgatcatatggtttttgtccttcattctgttaatgtgatgtgttacttttactggtttgtgcacgttgaactatccttgtatccctgggataaatatcatttgataatgatgaatgatccttttgatgtgctgttgaattcagtttgcgagtattttgttgaggatttttacatctatattcatcagggatattggcctgtaatatatttttttcttgcagtgtccttgtctgactttagtatcagggtaatgctggccttatacaataaatttggaagtattccttcttctgcaattttttggagcacttgggaagggttggtattagttctttaaatgtttggtagaattcagcagtgaagcatcaggttgtggggcttttctttgatgggagactttttattactgattcaatcttctcacttgttattgctctgttcagattttttgtttcttcatgattcagtcttactaggttatatatgtctaggagttcgtccatttcttctagtttatccaatttgttggcacaacattattcatagcaggctcttatgaacctttatatttctgtggtatcagttgtaatgtttcatctttcatttctgattttgtttatttaggtcttctctttttagtctaactaaagctctattgattttgctcttttcaaaacatcaactcctagtttccttgatcttttctactgtttttctagtatatttcatttatctctgctctgatctttattatttccattcttgtgctaatttaaaccttaatttcttcttctttttccagtttgtggaggtatgatgttaggttgtttatttaagatccttcttttttgatgtaggcatttattgctataaacttccatcttagaactgcttttgctacatctcatatgttttggtatgttgtgtttccactttcatttgtttcaaaatatttttaaattttccttgtaatttcttcttcaaccactggttgtttaggagcatgttgtttaatttccacatacttgtgaattttcaaaattcctcctattgatttctagtttcatgccattgtgattggaaaagatacctgatgtgatttcaatttttttaaatttgttaacacttgttttgtggcctaacatataatctatcttatagaaggttctctgtgctcttgagaatatattctgcttatgttgtatagaatgttctgtatatgtctgttaggtccattttgtctaaagtgtagctcaagttcaatatttctgtattgattttctctctggatgatctctccattgttgaaagtggaggtattaagttcccttactattattgtattgcagtctatctctctcttcaggtctattaatatttgcattatatatttagatgctctgaggttgagggtatatacatttgtaattattttatcttcttgatgaattgactcatttatcattatataatgacctttgtctctttttatagtttttaacttagtctctttttttatgtagtcaatgttctcctgaattaaggtctattttatctgatgtaaatatagctatctctgctctcttttggtttccatttgtatgaaatatctttttccatccctccactttcaatttatgtgtgttcttaaaggcaaagtgagtctcttgtaggtagcatgtagttgagtctgctttttttctttttttaaatcaattcagccactctttttcttagagaatttaatccatttacattcaaggtaattattaataggtaaggacttactactgtaattttgctcgttgtttactggttattttgtagatcctttcttcctttcttgctcacttgctgtttacctttgtggttagatggttttctctagtggcatgctttgattctttactttttatcttttgtgtatctactatagatttttgcttagtggttatcataggcttacataaaacatcaaatagttacaatgggctattttaagctgataacaacttaaccttgatcacaaaaacctctacgcttttactccagtgcccctccaactacattttatatgtttgtgtaataatttacatatttttatattgtgtatcccttaacaaatcattgtagttgttattctttttaatagtttggtcttttaaccgcccccccttttttttgagatggagtttcactcttgtcacccaggctggagtgcaatggcatgatctcggctcactgcaaccttcacctcctgggttcaagcgattcctgcctcagcctcctgagtagctgggaatacaagcatgtgccaccacacgcggctaatttttgtatttttagtagagatggggtttcaccaggttggccaggctggtctcaaactcctgaccttaggtgatccgcccaccttggcctcccaaagtgccgattacaggcgtgagcctccatgcctagccttaaccttcatactaaagatataagtgatttacacactaccatttcagtattagggtattgtgaatttgactctgtacttacttttaccagtgaattttatacttttatatgttttcctgttacttgttagcatccttttctttcaggttaaagaattccctttagcatttcttgtaaggtatgtccagtggtgacaaactccctcagcttttcttttctgggaagtctttatcatttcctaaaggacagctttgtcaggtaaagcattattggtttgcagggtttttttttccctgaagcatgttgactatatcatcccactctctcctggcctgtaaggtttcttctgagaaatccactgccagccttgttagagccctcttttatgtgatatgcttcttttttcttgctgctttcaggatcctctcttagtctttgatttttgacagtttgattgtaatatggcttggtgcagtcttatttggattgaatttgattggagacttttgacctccctatacctcaatatttatatctttccccagatttgggaagtttctaacttttatttatttgtttatttattttctttggtgccccttatgcaccaggaagcttttatttttttagataagctttctggttttttttttgttcttctcttctgcttcttggtcatccataatttaaatatttgttctcctgatgctgccccataaattctttaagctttcttcattgttaaagttttttcttttttctcctctgactgtatactttcatataacctgtctttgaattcacagtttcttcttttgctttattaattctgctgttgatgctctctgttgcacttcacattacattcaccaaattcttcagctccagaattttcatttttgcatatgatttcaatctctgtttatttttgtatatgattttgatctattttgttcatttatgtttctctgatttaattgaattgtttttttgtatttttattgaaattctctgagcttccttatagcaattattttgaattctttgtcaggcagtttatatatctccatttcttttgggtcagctactgggagattattggttttttgtttgttttgtggtgtggcatactttggatatttgtctcctctaaatcttatgttaaaatgtaatctccaatactcaaggtgggacctggaggtatttggatcacagggagagatcactcatgaatggcttggcagccttcccacagtaatgagtaagttcttgctctattagttcatgtgatatctggttggtaaagagtccgggacctccccccaatctcttgcttcctctcaccatgtgacatggccctttaccttctaccatgagtaatagcttcctgaggcctcaccagaagcagatactggtgtcatgcttcttgtacagtctacagaaccataaaccaaaataaacttcttttctttataaattacctagcctcaggcattcctttataacaatgcaaaatggactaatacagaaaaattagtactgagtagtgaggtattgctataaagatacctgaaaatgtgaaagtgtctttggaactgggtaacaggcagagattgaaggagtttggagggctcagaagaagacaggaaaataagggaaactttggaacttattagagactggttaagtggttgtgaccaaaatgcagatagaaatatggacagtaaaggctaggctgacaaggtctcagatggaaatgaaaaacttactgggggctggagcaaaattcacccttgttactccctagcaaagaacttaactgcattttatccgtgtcctaggactttatggacaactaaacttaagagtgatgacctaggatatctggcggaaaaagtttctaagcagcaaagcattccagaagtggcatggctacttctaacaacctacagtaagatatgggagcaaaaatcctcagcctgttcatgtggtagagaaggaaagagcatcttcaggagaggaatccaaaggagaaggatccatgcaggctggggagcaaactcttctagagagattagcatgactaaaagggagccaagtgctaatattcagtaaaatggggaaaaggcattacaggaatcttccaggtcacccctcccatcacaagccagaggcctaaaaggacagacgggttttaggggtcaggcccagggcacaattgccctgtgctgtcttaccttgcaatgctactccccacatacttgcagcacaggctccagccttggctcaaacagccccaggtacagcttgggtcaccactccaaagagtgcaagccataagccttggggcttccacatggtattggatctgcaggtgtgcataatgcaagagttatggagacttggcagcttccacctagatttcagatgtatggggaatcctgagtgcccaggtagaaacctgtcacaagggcagagcccctacagagagcctctactaaggcaatgatgaggagaaatgtgggattggagcccccatacagagtctcctctaggggactacctagtagaactgtgcaaactgagctaacaccctccagaccccataatggtagagccaccagcaatatgcactcagcctggaaaagctgcagacattctactccaacccatgaaagcagagccacatggcctgcacccaacaaagccatggggatggagctgcccggggcttggagggcctaccccttgcaccagtgtgctcaggatgtggaacatggagtcaagggagattattttggagctttaaggtttaatgtctgccctgttgggttttggacttgcatggtacctgttgttcctttcttttggcagatttctcccttttgaaaagggactgtttacccagtgcttgtattatcattgtatcttggaagtgaataatttatttttgatcacacagcctcataactctaaggaatttgccttgaatctcagatgagactttcgagttgatgtttggaacaagttaagactttgggagactactggaaacggatcattgtattctgcgatatgagaaagacatgatgagatttgggggaccaatgaggaataatatattttggatatttgtcccctccaaatcttattttgcaatgtaattcacaatgttggaggtgaggcctgaagagaggttttagatcatgggggcaggtccctcatgaatgacttggtgcccaccctatggtaatgagcgggttcttgctctattagttaatatgagacctggttgtttaaaagagtatgagacctccctctttctcttactccccctattgccaagtaatatatctgctccccctttgctttctgccatgtggaatagcttcctgaggcctcaccagaaacaggtgctggtgccatgcttcttgtacagtctgaagaaccataagccaaaataagcctctttttgttatataagctacccagcctcatgtattcctttatagcaatgcaaatggactaatacatggcgatatgtattcttggcttttcatgtttcttgttgccttatgttgaattctgcacatttgttaagatcaatcccttccagactttatgggctagtttcaatgtggaaagaccttcttctacttggaggtgtgaaggcacttcctggatgctgtgtagcagttctgacaccagtgagggtgccactgttgtcagacagtgtctctgtgcagctctgtcagctcaggtgttgatgttgctgaagattgcaagtggccaacagtgtggatgtctgcagtggtggtgaagattgttgggtttcactggtaatagctgctaagatcttctcaacttctttttctccaactgggtaagttgtggacaggagttcccttttggtactgggtccagcttgtgggccgatttgcattggcagtggcattagtattgatgaatggtaccctggagtagccatagagctgagatctgaagcttgggcatgtgtggagggactatggctctggggtctgctggtgcctgggagaaggcacccctactgctgcattggtaacaatatatgagatgtgagtgcttgtgaagtgtcagccaagaatgggagcacagacatagtcagagttacagtggctccggggttagggcagggcctagttctctgtggcagctgagcagatgcctgaagtataggcatgtacatgtgcagagagaccttgattctgggctctggggtgtaagcttgttctatggctatgtctctggtgtctgacacacgggtgggtgtagtgcagccacagagcctggtgtctggagtgtgttcactcgtggggcagctgtggctcgtgtgtcagggtcatacccaagggagggtggtggctgtagtcttgaagccacacaacagctgtttcttgggcggggaaaaccctacccaagggtttttttctctctcagattcaccagtgaaaatggctgttgttcaacctcaaggcagaagatggtgttacaccctgagaaacaggctgttggggacaggatggcttctaccatatggctgatgccagtagcctctgcctttcttctttgtttctaaccattttctggcatctctgttctgccagtctcacaagcaatcttttctgtgcaggtattctctgttttttttttttttttgagatagagtctcgctttatcccccaggctggagtgcggtggtgtgatctcggctcactgcaaactccgcctcctgagttcagtgattctcctgcctcagcttcctgagtagctgggactataggcacacaccaccatgcccagctaatttttgtatttttagtagagatggggtttcaccatgttgaccaggatgatcttgatctcttgacctcatgatccgcccgccttggcctcccaaagtgctggggaatgggcttttgagccctcccaaggctattttggtttgtggatacctgtcaatatttgttttgctgtttgggagtgaaggctgttttcttttactccactatcttaggtgacatcactctacatttacttcttatatctatttttccttcctagattcacttcttgatggagtaattcctctaagagcccttatatataaggccttcgtgtgattaactttctaaagatgtgccatccaatatgtgaccattgtccatatgtggctattgaacatgtgaaatgtgccctggatttcaaaaatgacatacatgcatgcacacacacacacacacacacacacacacaaacacacacaatgtaggttactcatatccccatatatgccagcattctgcattttgcttatacattttgcttttaatctttgtcaacaaaaaactcatgaatttcttagtattctgtgtgttgtacaaacagatgggctctgagcagagcctgagaggctcccataagagcagagacatgagctgtaatatgtagacattaaatcgcctaaaagctgcacggagagcttttcagtgactgtcgagtcctggaaactctcctggacaatcagcgctgctgttcaagtacactctgggcagagatgatgtcacagtacctctccataaaggaggacattattcttacatttaataaataaattggaattaggaaaactgtaggggaatttgggtagaggtgggaagcaggcattcagcagtcaggtgcacctgggcaggaggcttgctgtggcctgggtccacaggcctgaggatgggaggaagctgagatcaggccagggtgtctccaggtgggtgaggccacagcgtggtgcactgaacaggtgaataaatatagccctgcataaattactcagcaacgaagtggagctggggaagattaaccaggattacactgtatttataaacatgggttttaagctcattgttattaagaaatataactgagagggtatcatggaagattcactaactttggcaaagtggaacaaaaatagtaacagtatttattttttttgtatcactaataaatgagagtattacatataagtcagagattgcagcttgaagttcaaagctaggcatcagagtcctgtaattgtatgcaaaattttctttatatgtaaatacatgacttctttttctagggagagggtctaagactctaaaagttaagaactactgatcgtgtggtttatattcatgataactgaagtttttctccatttatgacaacttaaaaatatcattggcagtagggggtggggcagagaattctccctctagaggacaacatcacatctatccttgagttcataaaggtagtagactaaatataaataaatcttcttttctgggctctatcatgtcaagttatcgcaccatgtaatgatttggaaatgttcacaaggagcctgaatgcatcccctgatcaggctgctcaccccttaagagttaaagtccgtgctcccccgactcctgtatttcttagctccatttgccttgcaaggtgctcatctactttctcttctcttcctgttagcatcactttctgatagtgtctgtgcatcttcattctcctaatctgttgtctaattttacatgatcttatctgagtgagaggctagggatggcaaagcctggacaacacccatttttcctaaagcttagtgacctcactaaaatctttttcatttcctagtttctgtttgagccaaaaagctgaccactggattagtctgggcattgctatattgtgttaaaattgagcagaacagttgtggcaataacctctggagattagaatatattgcttgaaaatcaagccaaagagttgctgttttttttcctcattttaatttccaaccctctattgcctgctttatctcttctcaggcttctgagtgccgctggagaaggtcatagcatctttctgatcttatacattcatcatgtctaatcccagctcagcccactcagcagtcttgatgatttatttcattactcacattgaagatttcagacttatgcttttctaactccctgttggaatgtaagctctataagggcaaagcttttgttttgtttcattgaatcctacacagccaggagagagcctgtcacacaggagatgcttaagaaatacttgaatgaatgaattgctgtccagaaagaaaccttatattgggaaatggcagaagctcattgggccacccagagtggggcggagggtagcacaaggagccactaaactctaccttaaattcttccctaataacattggtgaattggatttcctgagattaagaacttcttttcattaaagaaagtaaaattccacagaggaggagaaaatatttgcaacgtacagaactgacaaagtgctcagatccagaatatgtaaaaaaaaactctaacaaagtagcagaagactcacttcccagattccccacctcctcatattgttatattggtgattaggttttaacaatatgaattttgagaagacaagcagtcagaccataacacctattaaaagatgccgcattccccttgctgagatagtagaatggtaatcaataaatactgagggaactcagagactcgcaccggcaggagaacagggtgatagtggggagaaggccagcaagaaaacgtgagcaaaggaatctgtgtcacaaataagttcaagggaaggtactatgcctggatgtgcacataggccagatttatgcttctttccacccaaacatctcagtgtagcaaagagtaacagagcatcattgccgccagcataccccacctccagccacagggtggttttctcctctcagaatagaaagaatgtacgatcaggttttacactgagtcattccattcccaggggcatgcaggatatggaggccttcctcttacctcaactgcaagaggccttcctcttttactaatcctcctcagcacagaccctttacaggtgtcgggctgggggatggtcaggtctttcccttcccacgaggccatatctcaggctgtctcagttgggagaaaccttggacagtacccggctttcctgggcagaggtccctgcagctttccgctgtgcattgtgcccctggttagtcgagactggagaatggcgatgacttttaccaagcatactacttgtaaacatattgttaacaaggcacatcctgcacagccctagatcccttaaaccttgattccatataacacatgtttctgtgagcacagggctggggctaaagttacagattaacagcatctcaaggcaagacaattgttcagggtacagataaaaatggaatttcttatgtcttccttttctacatagacacaataacagtgtgatctctctttaccctacagtctgtaagagaaagtgcttctcaccaaaatcagccaggagcccctttcaggttttatctaaagaaaacctgtctttaaccgccagccacatttcctgtttctttcttctttctttaactcttacactttcttctttcgcttattaaacttttgctccaacctcacccttggtgttctcgctccttgcttttcttggttgtgaaacaaagaacttggagtcatgccttgggcaatgagattgcttcacctggatggatgtgatgactcggtattgtaaagatgtcagttttcccccaaagtggtcgacaaattcagtgtgatttcaatcacaataaaaacttgacatattctaaatttttatggaagaatagagttcttctagcagcaaagttagagcaaagagggtgttccttatgcatttaaaaatattctaatagctataatgataaaatgaggcatgatttttccaacaacagacaaataaatcaaacgaatagaggagtgaacccagtatttatgaagattacatgtaagatcaaggtatcatctaatgaggaaagcatgagccttttaataaatagtattttggaaactgccttactatatggagaaagctaggttcctatccttcacagtgttttaaaaacaaaacaaaaccccaaaacaaaaactctaaatggattaaagaggcacacatgagaggcaaaacaatatatatgtttgtgactcaggagtgcagaagaatctccttaacaaaccctcaaattagaaagcatacaggacactgggcacggtggctcatgcctgtaatcccagcactttgggaggctgatgcgggcagatcacctgaggtcaggagtttgagaccagcttgctcaacatggcgaaatcccgtctctactaaaaatacaaaaaaaaaaaaaaaaaaaaaaaaattgccgggcatggtggcgggtgcctgtaatcccagctacttgagaggctgaggcaggagaatcacttgaacccgggaggcggaggttgcagtgagccgagatggtgccactgcactcctgcctgggggacaagtgtgaaactccatctcaaaaaaaaaaaaaaaaaaagaaagatacaagaaaaaaaaagaaagcatacaggaaaaaaaaaatgggaagaaaacgatcagcaaaaatgacaggcaggtaccaggacagggaaatgtatttgcagtatctaaaacctatgaggaattaacatctagagcattccaagagcttttttatatcagcaatataaagacaaaaagtctaaaggaaatcgcaaagtctatacagaaaattcagatggagaaaccccattgcttgaaaagaggtgtttaatcataacactagtcaaagaaatgcaaattaaagcaacataataccaaatcacacccatcacattgaaaaacaataggaagtcatctaatactgaattctggggagtctgcaaagaagaaaaacctgcaggcataggtggtaggagggtaacggatacagcctttctggagatccatctggcaggattctgagattaagtatgtgtacctcctttgacccagcaatcccactcaaagatgtaatcccccagagtaatagttgctataagggtgttcaatttagtataatttagccccaatatctagattattgcctgaaggataaaagcactcaacagatgtttgtgaatcaggaaatgaatgaatgtcacaaagagagcagaaagtaagcaatctgcacctgtaggcatggataagtaaaatgtggtatatccctatgagggaagaggatactacagtagttacaaggagcaaactgtatttatgtggagccacctggatagactgcaaaagcacctgtcaaaggaagcaagtgaaaaacggaatcagatttgttgaaaaaatcccattcatgtaatttttaaaaccacacccctcaaattattttttaaaaagttatacatccaaacaaatattagaagggaaattgggaggacgcataagcactagattggatgctccataacatcgacagaataatggagagaaataatgagataccaaaggggcatcttgcctgaaactgttaccagaaaggggtcccaatctggaccccaagagagggttcttggatctcacgcaagaaagaattcagggtgagtccatactgtaaggtgaaaacaactttattaagaaagtaaaagaataaaagatggctattccataggcagagcagcagcttgggctgctggactaaggatatatatttcttgattatatgctaaacaaggggtgggcaattcttggaaatgagtgttcctcccccttttagaccatatagggtgacttcctgatgttgccatgccatttgcaaactgtcatggcactggtgggagtgtcttttagcatgctaatacattataattagtacataatgaacaaataagacaatcaaaggtcactttcatcaccatcttggttttggtgggttggggctggcttctttatcacaacctgttttatcagccaggtctttatgacctatatcttatgccaacctcctatctcatcctgtgactaagaatgcataacctcctgagaatgcagcccagtaggtctcagccttattttacccagcccctattcaagatggagtctctcttgttcaaatgcctctgacaaaaatgtgctaatgttccaggaagtgaccatgaggaactcagttctgtgcacctgagctcctaaaaaccacccacctcccaaaatttcagaccagctcttggtacagaaagtggtcagaggaggattctattccttgtttcttgcctcccaactccctttcctccctgccttgaataacctctttctccctctgtgcatccatttacctgaccagtccccactcccaacaaagtgcccagtgctctgtgtctgtaacacaaggtgaaagcctttgggagcagaaaagatagttttcagacaaaattcagtctgcaacatgagagagcagcaaaattaaagccccaagcgctttgtccagagttattctctttaaaggaggaacttggcaacttggcatgcacatgttgctctcatggaagacagagaatgacaaagtaagcgatgagtttgaaaggtttttacccttgtacaaaaaacaactaagcaccttctgtttccctagttcagtgctgaggaaagagaaatttactcaggtacattatcagtcaccctgtctgctgtagcataaggaatatagaccttggaatcagacattccagcattggccttgggctctgtcatgcacaaaaagccatgtgaccttcagcaaattgagtcattgatgatactcagttactgtatctttaaactggggctatttatacctatctcaaggactggtgagggagttagggtatgtcaaactgggagcccagtgccaagatctcctttaggaattacagcctgttggggaaataagacacatgctttgaaacttaagcaaccatcttgctggatataaaaccaatatacaaaaaattcaatagtatttctatgtgcaagaaacagaaagtaaaattttaaaagtactattaaaatagcgtattattcatatataaatataacaaaatatgcatgattgtatattgaaatttgcgaaacattatagaaaggaaacttaaataaatggaatgattcaatatatcatgcatcagatcactcagtattataaagccatcactcaaagcaatcccaatcaacatcccagcaagtttaatctttttttgttgttcttgtcagaaattgacaagttggttgtaaaattcatatggaactgcaagaaccaagaacagccaaggccattttgaagtagaacaaaccccgaggattaccagatgaaaagctacaataattaagacagtatgggctgggcgcggtggctcacgcctgtaatcctgttacaaataaagttttggtgccgcaaaagaaatagcacttgaatataaaattttctttttaattctcagcaaggcaaggtacttctatagaagggtgcaccctcacagatggagcaatggtgagcgcacacttggacaagggaggtgaaggggttcttatccctgatacacgtggcccctgctgctgtgtcgtttccccattggctagggttagactgcacaggctaaactaattccgattggctaatttaaagagagtgacgggggtgagtggtttggcaggaaaaatggttatgacagagcaggtaatcggaatgagtcagggtggagcaggtaatcggaatgagtcagggtggagcaggtaattgaaaaaggttgctttatgacgaagttcagttaaaagtagaaggcaaagaattgaacatatgacatattgattctttgaaaagaaatttaggactcatatcaaacaatcccaacactttgggaggccaaggcgggtggatcacctgaggttagcagttcgagaccagtctgaccatcattttgaaaccctgtctgtactaaaaatacaaaaattagctgggcgtggtggcacatgcctgtaatcccagctacttgggagaatgaggcaggagaattacttgaacccgtgagacagaggttacagtgagctgagatcacaccactgcactccagcctgggggacagagtgagactcttgtctaaaaaaaaaaaaaaaaaaaaaaaatagcttggtaggctcaaggatagaaaaactccacaatggaacaggatagagagcccaaaacagacctagaaaagagacaccacgagcagtgggggaaaggatagccttcccagccatatatgcatggaccaaaatgaatctcaattcttacctcacacaatgtacaatggattgcagatttaaacaagaaagatttttaccttttaaaggaaaacatgatcaaatgtattcataatcctgaagtaggcagatttcttaaggaggacataaaatcactaaccataaaagaaaatcttataaatctggactaaatttggataaaatgaaagatgctcatcatgacacaccattaatagaatgaaaaggcaacctacttcttctataaagtagtagaagatatttgcactacatgtgtcagaaaaaagacttgtattcagaatatataaagaactcttacaaatcaacatgaaaaagacaagcaacccaatatataggtgggcaaaacactcagacaagagcttcaccaaaagggttatccagatatccaataaacataaataagctctacctcactggacatcaggaaaatgcagtttaaaaccaatattagacatcaatattacatacttaccagaactgctaaaatggaaaagagaaaatactaagtgttgctaagattgtgaacaaccggattttcatattttgttaagtatacatttattcaaccactttggaaaactgacagtttctactaaagctgtggttttgctttccacattttcagttatccatggtcaactgcagcgcaaaaatattaaatggaaaattccagaaataaataactactaaattttaaactgcatgctattctaagtattgtgaagacatttctcactgtcctgctctgtcttgcctgggacgcgaatcatcccttttcccagcatatccatgctgtttacactcctttccagttgccacttagtggccatcttggttttcagtctgactgtcgaggtatcgcagtgctcatgttcaagttacccttattttatttcataatggccccaaagtgcaagagtactgatgctggcaatttggatatgccaaaaggaagctttaaagtgctttctttaatagaaaaggtgaaagttcttgacttaaagaacaagaaaaaaagtatgttgaggttgctaagatctacagtaagaacaaatcttctatccatgaaattgtgaaagaagaaaaagaaattcatgctacttttgttgttgcacctcaaactgcaaaagttacagccacagtgcatgataagtgcttaatgaaggcagaaaaggcatgacatttgtgggtggaatacacgaacagaatcatgttcagattgacagcaattgggttcagtattattccaggtttcagggacccactcttcttacctaacaggaatgtgtgcacatgtccaccagaagacatgtattgggaggtgcattgtagtgctattcaaaacagcctcaatctgataagtacttgaaagcccttctcagcaatgagaatgaacaaactacagctatgcacaaaaagatggatgaaattcacaaacataaggttgaggggaagaaatcaaccatgaatgaacttcacagacattctgtgggcaaaagcagacagactcaaacaagtacacattgtattactctattcatgattccatttacagaacacataaaaacaagccaagctaatctgtagtgctggaagttagaagagggattaccctcaatggggaaaggtggtagctggaagggggtatacgttgaaggataatggaggtgttagttatgatctcctttcttgagctgggtgctggtcacacaggtgcatttgtgaacattcaccatgctgcatactcaaaatacttgcactttgctgtgtgtctattatacttcagttaaagggtttttattatcaacattaaaattaatgtctttggtgaagcttctgagtactttgcccacttatgtattgggttgtttgtcttttcatgttgatttgtagaagttctttatatattctgaataatagtctttgacacatgtactgcaaatatcttatactacttcgtgggttgccttttcatccttttaatggtgtgtcatgatgagcagttaaataataaagagaagttgtctgaaatgctgaccatcaagaaccaaaggggccaggtgtgttggctcatgcctgtgatcctagcactttaggaggctgaggagggaggattgcttgaggccagaagtttgagaacagtctgagtgagaccccatctctacaaaattaaaaaaaaaaaaaaaggctggacacgatggctcatgcctgtaatcccagtgctttgggaggccgaggtgggtggatcacttgaggtcaggagttcaagaccagcctaaccaacatggtgaaaccccatctctactaaaaatataaaattagtcgggtgtggtgttcatgcctgtaatcccagctacctggaaggctgaggcaggagaatcatttgaacctgggtggcggaggttgcagtgagcagagattgtgtgccattgcactccagcctgggcgacaagtgagactctgtctaaaaaaaaaaaggaacttagccaggcatagtggtgtatgcctgtagtcctagctactggaaaggctgaggcaggaagatcacttaagcccaggatttcgaggctacagtgaactatgatttcaccactgcactccagccttggcttcctgagtgaatgagactctgactcaaaaaaaaaaaaaaaaaaaaaagaaagaagaaagccacacacacacacacacacacacacacacacacacacacaccaaaaaaaaaaaacaaaacaaaacaggatgaacacaggcttagatgctatgaaagtttggagtagaagtggttggtgtggcctggagaggtcccaggggtcttcttggataggagcatttaaacagccttgagggcttttgatgaagggaagaagccctttggctctatgtaaaaaaataacctttgaaaaataggttgatgattataactggttctttcgatgcagggaaatttctgaccagcctcgtgtaattttgaagaaaatgattaaaaagaaatttcagtgtgatgtggtaggtacagagagaagcatactttcctctgtgagcctaataaagttactcacttctctgagctgcagtttctgcatctgtaaaatgaaaaataatgcctcttcagagggttatgagtgttaaatatgatggttggcatgaaactgttagtgtggaaaaaaagaaccctagacagcctttattagtccctaaataaacagtgtattgtatatcgggtttaaccatagcaagccttttctagatctcccacctccaagaacctgtgggtgacattgataaatatataaacagctaacttcaggcttccgctctccagattggaacagttgttcatcagcacaaaggctgagggtgttggtgctgggatgattcacagagagaagtggagtgggtctatggtcattatgcagtttattacttaattccctttggctgctccatgccctgcctagagatgaagcagcacttttatttgaggacaagaagctggctcacagtgggtttgtgtgtcccccatgccaaatgtgcttgctttgtcagactctgcaaggttgctccctcctgctgaaatcctggaggtgcaatgtcatgagttacaggaatcccaggatacaggagatggagaatgaactcaaaacctttactgccaaatttgctgctccttgggattgtaccacctctttcctggtctcctggtagcagcctcatattagacttaattatgctaaattatttaggctaaattatctccctgtacctagactcttcttatcatgccctctaccaagtaagatcttctacaacaggaatctgaacagggcactgccctggggataaagtgccagctccagggcagactatacaagtttctctgagatctggccttgtagagtgctggaggcagagagaccatcaggatggttgttgtgtcctgagagagggacgatggtggttcaaacaaaggcagtggcagccgggaggtaagaaatgagctgctgaaaaaactattaaggaagtagaatcaataggaagtaaagaataatctacaggaagtaaagtcaaatcaacaggaagtaaggttgaatcaataggaagtaaagaagagtctgcaggaaataaagtcaaatcaacaggaagtaaggttgactcaacgggaagttgagtaaaatcaatgggaagaaaatcagctgattgttgtgtgtgtgtgagtgtgtggttgagggctaggcagggggatgaagaagggaaaggaggagtagattttcttcccagatgctttcctggaaacagtgtggttggggatgctatttactgtaatgggagcatagtgagagaagcaggttttcttaacctgcccccaccatcccctacccctggccccccagcaccccagccacagaacctgagagaaaagttcacagtggggttgtttagttgagaatgtaatgccagaaatcaggaatgagggccttgggaggtgaaatgggaaggagagacccaaggcaaggagacattattcaactggccaccaccatgagtgactggttgctcaatcccatggaacttctgagtcactttatgaaacgcatctcaggactgtcctcagatgatgaaagtggaaggaaggcattagctcctatccctgttggcccaaagctgcccatagagttaacatcctacacttttgattgcatggatctgagggcccaggagtgtgacaccctgagagaagcccaggggtagggcacaagagacatacagccctaacctgagaaaaggcactgccaaatggcacctgcgcaaagccagttgaagctcggtggaacaggccatcacagcagtggctggaaagagatggcgtagagggcaagagcggtggactccatctcagagagctgtgtgagagtgatccaacatccagttcagagatgaatgtactaaaatataaaatgatacctgaacttgagaagcccacaatcttggaaggaggacatttaaacacaagttacacagcaaggtggggagagtgccgttgctgctaattgctgtgaatataaatatctatttacttttacggggcactgctttaagtatatgctttactgtaaattctctcatttaattctcacagccatcctatcaggagttaatattatccccagttcacagatgaggacatggtgatacattgtccagagtcataagctagtaggtggtacagccaagatgcaaactgtttaaaccctttggaatgatcaaaggaagtagatactggatctgatgagttggagggggcagatcagccatgagttggttataatgacactcctttgtatatagttagtgccatttttgcaaaggcatttacaaatatggtttaattgatactaataatacaaggcaggagtcatcgttgtcatctttatttgatggaagaggaaacaaaagcacagaaaggtgaagcatctttacccagatcattcagaggatcagcagtggggccactgccggccactgggcagctgatggctagtaaatctcccttctgcactctgctttggaagaaggatgaccagaaaggcctgggcccattggcattccagcactgtcctcaagtgagtcaggtaccactatacagactcaattttaccttcggtaatttcctccttctgtaaagatttattttaggctataggggggcaaaaggattcctcacagttaaaagcatttgccgctcataccaatgtccactatgatcttcaccctgattctggacatggagggaaaggtttgtttcctttagaccacatctcctgggccggccatgggagatggtgacagaagcttgtgacagaagctacattctagagagctgaggatatttgaagatatgtgagtcaaaagtgggagtagagagcctggcccagggcaggtgggccaggcctgaagtgagaccatgaaatagacaagcccacagaatcaccccaagaaccagggggacaagggtgtggcgggaggacactgtccctacctctgaggatggagtttgaggtctgtcttttcagcctgctcacagcagaggccctgaggactcatttcctggctctgagccccacttttcctgtttggcttattggttaaaggtgtggactgtggagtcagcttcatgtgggactgactcctccactagctgaggggccttggacaaagcacctaacgtctcactgcttggtttcccctctgtagataggagatgttgataagggcagtcaggaggattggatgtgttaccttaggctgagtgctgaggaagaggcctagtgtacagggcattgagaagtcacgtctgaaatatgagacatcactcagccttgccccgaggctgttgtgagatcaaatgaacactgtaaactgcaaggcaggcaaggcaggcaaagctaccacgtgggagacactcatgctcctctacacggagccctccccttttaaaacctgccctccaaagaggctctggaatcagccttttgagccacactccctgtcatccagctctcagcatacttcctccagcctccacacctgccacctgccacctttctccttgggatcccctctgcccaggccagctgtgcacggaacccacaaccatgagctgccggccctggctcttgaccaccaggctcaacaccctcctttgaccaaaacacacagtgtgagcctgtctggggccccactcactcaggactctaacattagagtcctctgatgcttgtcttagtccagagaccgaaccgttcatctttgtattctctgaagtgctgagatcagtgccagacccagaagagatggttcagaaacagtaatcatgatagtgtgtgtgtgtgtgtgtgtgcgtgtgtgtgtgtgtgttggagagggtggtatgcacaaggagctaggctgcatgtaatcctctcagcagccctatgagttgcggacaattaatatctctattttataggggagggtactgagtcatgcacaggtaagtgacttgcccacagtcctacaggtaagcaagagaacagagattccagcctaggcagtctagccctcagagttgtgctttaacctccagcatgtgtggccactctggatgaatgggcattgggctggatgttggattgggattggattggtgggacatattgcccatagcagctcatcaagcaagatttttgttgtcctaactcccacccccacctccaccccaccctctgagttattctgcaggcaatttgaccccaaggggaccctaaaatgtactgtaaccccaatttgaccccaaaggatattattgattttactactctctgcagatggagctgacacatctgactactcttccaaggacttggagcctatttttcctggaagagtggatgcatttgctgtgagtcttactcagctccttggtccagttgccttccagtgtggcataaggggtccagactgtgtccactgccctcagatacccatatctacctctggaggagccagaagaaattactctgcaccagatcctgggggcagaggatggagaggatgcttaagaagaatcaaaatgtacccacccaaaccctctggaggtgcttaagagagaagccattggaatcacacctattgcttcctggcttgtaatcttgggcaatttggctggcgcctcccagggtcttagcttccccatctatgacttgagatgattcctaaggttgttgtttttagtagcctttgagccccattgttctgtcttctgaccttgcattggctcttagatccccagggccctttcccttttctgtctgcaaaggtaggtagcacagctggctggctcttcaatgcaatgtgcactgctacagtgaggaccctggacaacacctttcattgcactaaatagcatcacagttttttttttgtttaatttatttatttatttattttttaagaggagcataaaaaagtataagtaccttggcaggatgttgactttgccttcctaattaaatctaggggagaatccttgtggaaaagatgccagcaaaatgtatctctgaaattaattatgatagctgaatcagcattggatgagcaatatctttcctcttatcttcctctgacttggatgattttaaaaattcagttattcattctctcagcaaacacttaccatgcttttgggcactgtggttaagcactggggatttggagataataataatcaggatgcctggcgttgggtgccagaagctagaggaggcattcttcatgcatcatcttatttaatcctaactctatgaagcaggtgctctcactacccccatttttacagatgaagaagcaggatgaacacgattaagtaacttatctaacatcaccaatggtcaaaggcagaccctagattcaacccagttattcttcagcaagttggtaggggaactccttacgctttctttgaaatggagcaattgccattttctcattcttatgcagtgtgtcaaaaccactctagaaactcttttatttttatatcaggagtgcaacagtactctttctgggcagttatagcctcaagacaaatctcctagcaccccctcttagtctaactgccatccctaagtctcttctgtcaagtaagtctgtggcaacccccgtagagagacaaagagtaaatgcattagtgcatcaaaatctcccatgtgttgagataaaggtctctataacatataaggcagacacaaaggagagtcagctccacttaagatgatggcctgggcacaaaacttatgttagttcatataggtaacatcagctgctgtaacaactaaagtcccaagttccagtagattaacaaatgcaaattgatgtctcagtccattgtgggtatgatggctaattttatgtgttgacttgactgggctaagccatgcccagatagctggttaaatattatttctgggtgtaggtgtgtctggaaggttgtttctggagagattctcatttgaatcaataaagaaaattgccttcaccaatgtgggtgggcaccatccaatctgtccagggcccaaacagaacaagaaggtagaggaagggtgaatttgctatctctatttgagcagggacatccatcttctcctgccctcagacatcagcactgtaagttcttaggtctttggatagaccaggacttacactatcagcctcccaagttctggacctttgcattggattgcaacttatactgtgggttctcttgcttctcaagccttctgactgagactgaattatatcactggctttcctggttctccagcttgcagacagaagatggtgggacttctgagcctccataacatcaaattaatatgtgtgtgtgtgtgtgtgtgtgtgtgtgtgtgtgtgtgtgtgtgtgtgtgtgtatcatattgattttgtttctctggagaattctgatgaatatggtgggtactcttgtttggaggtggtcatccccaaggccatccaggtagccatgtccctctcatcttgtggctttgcaatcccatggggtctcacagtcctttgctggatcctctgtatctgggtaggagacagggaaaggacaggggccaaccataggaggctcccatgggccaggctgtgagtgagtcccatcacttctgactcatagtccaatgtccagaatgcagagaccctggcttcagaggaggctgggaaatagggtatggctatgtgtgcaagaggaaagggagcaggtttggagagcaactggtcagtttctgccacaggcctccacactcaatccatcccattttcctgaaattgcttctctgcaagtgtctgttcccattacagtgtgcccttaaagggcagaggccacttttcactggaatcccatgctggaacacaaggtcttgggcataaaaggagcttgacacatttctattggctgacagatgaaggcatcagtgaagacttgggttggatatataatgttatatatccatccagttttatataattttggattagcattgtgatttgcaaatgtgatgcttacttgtgtacatgaagggttctgatttggaaaagaaggaccttcttccattggaaaccaacttgttctttcgatcaagcaagactcagcaccgtcattcatgggatggcagacagactatgtaaactagcctgtgtgttattttggcaataataaaataggatggcaaacatcatcattctattcaaaagagagaaccttttctttggcaatgactgtcattattgggttcattatgtggttgatcaggaagccccctcaagagtcatttgccattaaggaaagacaggcaaaggctagtgggggtgacaacagctgccaaatctttttaaaagccctgaaatatctagaccagggttcctcagcctcagccctactgacattttgggcgggatctctcttgtgggggtgtcctgtgcattgtaaggtgtttagctgtgtcactggcctctacccactggatgccagtagctgctccacaaccgttatgacaatctaaaatctctctagacattgtcaaacacctcctggaggtcaaaatcactctgggccgagaattactcatctagagagttcctgatgaaggatgcagaggcaaggaccacatttcccagctctctctcacaccctctgtaaggagcagcatggatcaccaagcactattgtttctgacaaggcgtttgcacactcctcagttatgtttaaggaaaacgtggctgtgaacactatctcagctgtcgctttctagccccagtgccgagcaaaaggtcaggttggagggatgaggtgagcagctcaggctgcctcaaaggaggctgttccagcaagattgttccatgccacatgtcacaccgggtggcatccacaaagggacccttctgatggaatctcagaagggggtctctcccagtgggcctaggtcagtagagaggacttggtcataacatgagatagaaaagccagcattcctccctggtcaccaggtgttggagggtcatcgcctggcttctctgccccatgaccctaattcagagagaagagagcattgctcagtgtaactctcttactttaaaaaagggttctctgcaacatgactctatatttggtgtctcctttctgttttcagctcaacaacaaccttggaaggtagacagactggaaagcattggccctatttcatggatgaggaaactgagactaaggttgaatgacttttcccaagaagaactcaaatcattatatcatggaccagatgagtccaagcaacccaagtgtttccagtgtgcaggctcctgtttgaaatgcaaacttagttggaaatttggggttgttagattcccagccatttgccatgatgagcctggtgaggacacagggttttgcagaacatgtatgcctctcatcctcccttaggcaggatacctgagggatgggtaagaacccagtggccaggggaggggttggggtgctggggacggggtgcttgttcttatgcatgtggtgaggacaacatgtgcaattgttcttgtccaggacatgttagccatcattgcccctctcctgttgtgttttcctgctactcaacacagttggttctgttctccataaaacagtgatgaatccctcacaggggaataggtcttgtttttgtttttgagtaatgtaatgaaaatctggaaagagttcactagttctggagaaaagataggccctcgctctgtggcttatccccatgcctattaccttggacgcttttgagtatgctgttcttcaaaggatgctcttgttttatttcagagtaattagtatttattagattagcattttttaatgagacaagcaattagaactcagtgagctggcaacataacaaagtaaatagagggcatggaggtgggggatccagctcaaagggaagtggaagggtcacccacatctttccaatggtcctggaggtacaggggcagcaggacaatgggacatgtggcttattgggaaagtgagggacggaagggagctcctatcagcctggaattgaactgcaggcactgcattcattttcatgcttaaccctctcaacacccaatgataaagagctgctctccaggaatgcctggaaatcccctgcgtctccattaaaccaacatatttatgagcttttttggtgtatgaggtccttttatttgattatcacaaattatgagacttctctattgttatccctatttgacaggtggggaaattgaggcccagacaagttaagggtcataaacttaaaaaagcaagtgtttactggcagaattgtatggaaacccaggcctgccccttccatggcaccatgctgtatctcaaccttgatcataatgaggtgtgacaacaagaaacggggtctgggccaaaagatagacgatgcattttgcgtgggagacaggttgctgatgcattcaatgaagaaacaatttcctgacattttgcatttggttgtgggcagtgtaaggtgagggagacagagactaattagatttctgggaaacagagaagtgggtagcagcaagataggaaggaagctgagaactggaaggaggacatatcctcagggtgcagacaactgcgtgaaatggggggcaaccaggatgccctttaagaaggagaaattgaagctgaatgtcggtctaggtgcccgcctaactagaataaccagagagacttcagagaaaatgagaactggggagtgacagtgacttctggcactcagacagtggtaaagctcattgagatgaatgtttgaaatccagttctctgcaaagccaggaaggagaccatggggatccctatttactttctgtttctaggctccattgtgtctctcttctcagagccataagaagaatttctgaaggcatcaagtgccttaattagattggcagggtcacagcctctctttaacccttttgatgcactcaaatgacctgtttcttttaagtaattaagcgtatgcaatgtttcttatagaggataaatcattttcttgcttgatcacattttctactttggcccttaaactgagaaattctatctttttggaaatgatggaaagaggttgtatctgttagttcactcatatcaattcatgactcccatagataggaaggggacttcattggtctggaggaatgggcaaagggactgagcataggtgtcttgagttcttctgggctctccctattggcatatccagtctaagataatgtgttttccttttgctcctgtccttccatggggtaagcaaacctaggtgaagcccaaatcagtcttggcaactcaagacttagcccctctgtgattaatcaggtaggattagcccctttcttagcccctctgtaattaatcaggtaggagtcagtttcagttctccttcagctgcttggagaggtgtctgctctgcatatctggctttcccattgtgtatattccatgatctttatgcttcccagaggagacgatagctatgctgagatgtgaaaaattactgggaatcagcaaagagaagatgcattggaagagccatccaaacaaagggcatggcatgagcagtaaggaggtgagacatgggatgacgaaagtagggacgggcatgtgtctgctgtttccacagcacaggaggtgaggcggggagtggtaggagtcagactggagtggtcagtttggtcaatatcatggcatccttagatgctgagctctggagctctgactttatgatgtagactaatgagtcctaaaatacttttcttagaaagccagtcctgtgaaatgctccttgggaaaagtcctgaggccaagtatgtttgggtaatatcttagagattcccaataaacagtagcccattgggcactgagaagtcctccaatgaagaagactattcagttgattaacttggtaaccatttttaacattctgaaaagccatttttaaaaaaaccgctttggtaaacactgcttatgggcaatccagggtctttgaaaggtcttaaagaagagagtgattctataggatttatctttaacagtgtggagaatggatttgaaggaaacaaggctgtgtataggagaccagtgaagcaagggttacaggaattcaggggagagatgctaaggatacacagagcactaggagatattaggaagtaagcagtttcagagacatttaggacataaaacaatcagaacctggaaatctattggatgtgatgagtgagggaaggaagagtcaaggatgacttccaggttaaatcaggttgatggtcatgtcatcaactaagagaaagagcactttgatatgttgactttgaggagtcaatggtatgtcaaggaatagatcaggtatgcagatagatttgagtctggctcatggaagaagttcgggttgatgatacagtctttggagttgtctgtatttagttggtgatttgaataagagcccccagacaagcgtatgtgtaaagttaaaagagtcatggtctactactaaaacgttaaggaataacttcaaggggcagaaagaggaggaggtacctatgaagaattttgagaaagaatgaaagtggtatgagataaaccagaagctgttgctccatagaagtcatggtggtaggagatttaagaaaagtacagtgactcacagagtcaaatctaagagacaggcatagtgagatgaggcatggaggaaggatgtggccattggctgttggaagctccctgatacctttctgagagtggttccaggagggcagtgggaaggaaggctgattttaatgggcttggaagtgaatggaagtcagtgaatgtcatggaaggcaagtcctttgacaagttgggaagagaaaaatatgagagatgggatgacaactgaagtgagaaagatctaagtatggagccagtgaagaaggggaggctgaggtgcaggaaaagacgggacaatttatggaacaacaagagcaaagatggaattagagagttgaaaaaggacaagtggaaggttttgacaacagagtagggagcccaactgaggaaagaccattaattttagtatatttgatcaatgtagttgcatgattttcctcatgcttggcaatctagcatagaaatagagaaggtggggcactgcattgatggagtgatggagtttcatcagctggttgcagggcacaagagaggagcaagggaattaaggatgttggtgaaagaatggcttagaaagtccatgtggagtaaaagcaccagagggatgaaaaatgggcacaaacaatcccaaagactgggagaaaaaggacaggctgaagggggaagagtgctgataaggccaatatgaaataaagtcttgagaagatgggatagttagatcagagtatctaatactagacattatgacttcagagggaggaaggtcccagggatgaggaagtaaaggaagtggctcagagaatagatactgaaaggtcaatgaattggaggcataggtgttgcagggcctgctgcagggatgatgaggctagaatagatgacttccaaggcccccgctgggtttgcgatataatgtgctggaaggtgtcagccagcatctccagtgcttgaggtatacctccacctactcactcaacatctcacccagatgtcacacaatcaccgtgaactcaactggacaaaaattgatttcattgcattgtccctgaagcctgcttcccttcctgtgctccctctcccagttaatggcccaccacctattcaataactcaagtcagaaatctccccaacacaagcctcatcatttctatctttgatatatctcacagtccagtgctctcctcttcgtgtctccccaatactattaccacttcaccctcatgggcctctgctctgttacagtaactgcagcctgcctggttttcctaccatggaaagctgcccccactccctccattctgccttcaaggtgctcctacagtgattcccttaaactgttactcagagcataccatttttctgctcaacaacagaagttcgaacccttaaccaagcattctatgcccttcagtatctgcttccaacctcatttccagcttcattgtctgtatcttctattcacacatcttcaagttccagccgaaggagtctatctcctgtccatggcttctgagtgttctaactctttttctttcttcaggctgttacttctgcctagaaagtcttctacctcccccagtatgccctttaaaatcccacccccttttttaggaccagttcaaatgtcaccccttccattaatctaatctccgtttgcctctctccaactaaaagtaatatgctccttttgtacattcgcaaaggattttaatgaaacttcatacagttacagcattttgtctgggcttctggtcaatgccatgcacatctcacctgccctgtaacgctgggagcaattgggagtggcagccaagtcttcatgtttttccacattgcttcctttgaggtaatggggggcctgtagttagagccaagtgggaatctcagcttcaccgcttggaagctgtgtgacttgagtacgtttctgaaccactctgagttttagtttcctcaaccctaaaacacggataatgatactgacctcccagcattgctgtgagaattaaatgaggtagcaaaggcaaagcaatgccacttgcctggcacattgtaggtgctaactaaacacctcctttccctatgaagtcatagttttgagtatgtgaaaaaataaatggaatgaagggaatcagttgttaccttttggactctcttttggagaggacctgtggtatggcctggatctgtgtccccacccagacctcaagttgaaatgcaatccccagtgctggaggtgggacccagtggtaggtgattggataatgggggcaatttctcctggtttaacacatccccctagtgctgttcttgtaatagagttcccaggagatctggtgatttaaaggcatatggcacccccgacctgggcttttccttctgctacagccatgtgagacatacctgcttcctctttaccttccaccatgattaaaagtttcctgaggcctcccaataagccgctatgcttcctgtgcagcctgcagaatcatgagggaattaaacctcttttctttataaattacccagtcttgggtatcttttatagcaatacaagaatagactaatacaacctgtttaccaggcaagggaaagaagcaagggggtaggaccaaagaagatttctccttttttacttccaggattttctttaatgaacatctcttatgttttaagttagaaagcatttctataagtgtctgtatatacacaagaacatacatataagtatttatatatataaaacacttgtaagtttataaacccttatatgtaagtatatatgtatacacgtttatatatgtatatgtgtttatatataacatatataagtatatatgtgtgtttgtagacatatatacacacacacacatatatatatacacatatatatatacacacacatacttattttatattagaaaagcctttgttcactgaccattccagaaatgttttgggcttgctcttgagttttcatctgaagactgccagctaagcctgctttaaaatgatcgtctctctgaatagtcttgaagttacccagatcctctatggagatcccgctctcccctcattttcacattcaatttcctttcatttttctctagggcaactcctgcaatgagaagttttaattgttgttctccaccaggataggaaagggcacacagagcatgtttaatattttgtttttcctttgggagtgggtgatggacgagatgcattcatgtgctaattcatccccagatcatgttgctgccattctctttgaggtggggagaaccatcatgctgaggatcctgagatatgcaggggccactcaaaagccctagagaatgagaggtgctgggtggggatgggggccaatgtgagtctgatgtgggatgtagctgaaagaatactggtgaggagacagccccatctgtgtttggtcccagctctgctgtgtccttactttgtgaccttaggcaaatgccttatctttctggccctcagcttggtcattgggaacatgagagcacaaacatccatttcctaagcctcttggagggctaagcaaaggtcattaaagaccccagccaaaaccatcattctcagcaaactattgcaagaacaaaaaaccaaacactgcatgttttcactcataggtgggaattgaacaatgagaacacttgaacacaggaaggggaacatcacacaccggggcctgttgtggggtggggggacaggggagggatagcattaggagatatacctaatgtaaatgacgagttaatgcagcacaccaacgtggcacatgtatacatatgtaacaaacctgcacgttgtgcatgtgtaccctagaacttaaaatatgattaaaaaaaaaaaaggaaagaaaaaaactcataaaataaaaaacatcacaattgtaaataaggacaaaaaaaaaaaaaaaaaaaagagagagaccccagccacagtttctatgcatgaagtaaaggctcgatagatgaaatcccgggcacccatggctcctcatctgactggagaatatgccttttcagagaatgctgacattcacgtgacattcaatttcaaggcaagcacctactaggcatgtccagatgatatggacatgtctgcctctgtcctcaggacatgacaatctagtggagcttggggaaggatgaggagatattgtcagtcctcaagttcagaagagttggctggaccgagcagggtcctagggagtgcgtcgcaaaggcggcagaagactccagaaagcagcaggaacaacccatgcccaagatctgacgccagaggcataggctttgttcctgaatattgacatccttcattcacagatgaagaaacagaggcccgggaaggttcaagtgtcctatccaaagacacaggttctgcctgacatacggaactcagtagccacttcttgtataagttagaaaactgtgatgatgctcttactgccaactggtcttcagaaggtttctggtcctccccacccttccacaatccattcttcctacttgattgcatcattgtcctaaggagctgccctcattcctgcatgctctggtgcaaagacctttaatggactcccacagcacatgcgagtcctggggacaaaatccagggctctgcaaagcctaacttcaactcacctgcccaaccttacctctgattacaaagttcttcttggtggtctcctcctaagcactctaggctctggattgctataacctttcatctcacaatccttgtcatttccttcctccatgcctttgtttatcttagtacttttcctcaccatttcctttgttttgcaagctcctcctcagcacctcctgcctttgaagttctagttaaatgtgacctccttggaaagaaccatgtcctgtgctcacaaggcactgcctgtccctctggagtttccccttcacatcttgccatggagtggagccatttgtgttcattactcactcatgagtgagctcctcaagaatgggagaatgaggctgatttgcctctgtgaccccaactcccacccagggtttggcatggaggagttgcccagtatgcacttactgaataaataaataaatgagcatagttcctgttcatctgccaggagcttggggtaaacagggcatggtggggtgggatggggtggttgactggaggaattgagaacatatgagttgctgagaggagtgggctacaaaggctaagaaggaggctgggctcagacaaggagctatggtgagaatccggaccagcctgggagttgtgtgtcataggtgccatgatggaggtggtgggtagacatcataatgcctgttagcatgtaatagatgcctatgatgtgcccaaacttgtattggattcatcccatgccttccttcatttgctccttataataaccctacaaagcaggtttcattatcaccatcagttattattattcttatttttcagacaaagaattcaagactaaactgggcatggtgacacgcacctgtagtctcagctacttgggaggctgaggcaggagaatcacatgaacctggcaggcggaggttgcagtgagccgagattgtgccactgcactccagcctggccacagagcgagactccgtctcaaaaaaaaaaaaaaaagaaaaaaagaaaaaagaagaagtcaagactaagaagagtgaagtatgaagtaattcacccacagacacccagctagtgagtggcagacctggaagacaaactagttctgtttggcatcagaatctatgctgtcagccacctcaccacattcatgtgacatccaacaaagtggtgccttcacctgctactaagtcttgctagggctagttccagagccaagactatgaagtggacaatgatctatgaagcgctaagtgaacagatgtcatgtaaatagcttggatctctacgtgcatgtgtgcattgtatatgtttaccaaagaccttgttacagtgtttttaggcatggctcactttataaaggtcatcacagttggccaagctatctggtatttattactcatttgatactcacacctgctcaatgatgctggtatcattactctccataatgattttcctatcattttacagatggggttcagaaagatcaggtggtagatccatagtcacactctagttaattgataggactgagaattcaatgcatgcccactgccttctcttacaagtcttggggtatttgagtgtaattcaataatgacaaccccttcactgtccaaaaggggtgaatgaaacatcaagctgtcacaaaggctaggttggagggcatggcttatatccttgggtaagtaggcttactaaacttaaaccctaaagttgaactgacttaactaccccgtcccagcagctggagtgggacaggacactgggtctatatggagaggggtctgcccagattagctttaggacgtggagaagcagagaactcatgttcctacaaacaggttcactctcaagataaagacaaggaaccaaactcagcctgcctgcttcattttttcatatttgccaatcagataagtcacttccgcccccagagagatttaataaaggagcagagaaagacttctaataaaattccctccatatggaaggaaaaggagacatcgggagttacgttaatcatgctcatttcttaacagtgcaaatatcaagagttagaaattagagttcctggctgggtgcggtgcctcactcctgtaatcctagcactttggaaggccaaggcaggtggattgccggagctcaggagttcgagaccagcctgggcaacacggtgaaaccttgtctctactaaaatacaaaaaaatagccaggcgtggcagcgtgcacctgtaatcccagctactcaggaggctaaggcaggagaattgcttgaacaagggagccagaggttgcagtgagctgagattgcaccactgcactccagcctgggtgacagagcgagactctgtctccaaaaaaaaaaaacaaaacagaaataagagttcccacatgacagcaagaatcactgaaaatgctggacccactgtcaatgctgtattgttgcaaagaaaatgtttatcttgcctaactttaaagtcacacatgcctgggaacttccaactagaacacagctggcaaagcagacaccctctccctgcagcctcgttgaaaatgacctcctttacatttcctcattgagaatctgcccagtgaggactgtggcagaagagagtcagggagaattttctagctgattagggttagaaaatgaagacgagggctctcttgtaatcagcaggaagctatgatagaaaagaatgccttttaaatttgaagtgcaaaactagaaaatagaaaattattaggggggtttgatatgaagtttcggaattcttttcaagactgtgtgttttgaagttaagattttaaataatgtaggaaggtacagtctatactgatgggttcaggatatgctaacccaaaatatggcaccttggtgtttgagaaaatggcggaagcaggaaggtcattctcaccatccacctccctttccccctcctgaagcaggtcttctttgaaaggcccctccctgtaaccagaagaaaggaacattcttacctttgaagtcacagggtcacagagaagaatctgaacaggacttactaaattcttccagtttgtcaccatttgctcataccatctttgtccagttatatttctccaaagctatccactcttcatcaaacttagcataaaaattgtaaaaccttacacatttcttcaggtcttccttttccttaggaagcctcccatgtcacatgaaacttaaataaaataaatctgtatgcttttctcttgttaatctgtctttgcgaggcctcagccatgaatttagtgatagatgaatttagtgatagattcttcctcccctacagtgcctagaaatgcattaggttaaatgtaataataattgaaaattgccaaagtgtccctgggtatttatccctttttaaaaaaatcagctttatggaggcataatttacattcaataaaatttaccaattttaagtgtataatttataaattttgacaagagtatgcggtcatgtaatcactaataataattattgattagaaaaatatcaaactcttcctatagtgtttgtgtcttttataaagcttcatgaggttattcagtgttctctaagacttaccagatttaactaattttatagaaaattctacttttgattaaggagtgattgaaaaccttccttgccatcggcgtgcacttttttttttgagacagagtcttgcactgtcagccaggctggatgcagtggtgtgatcttggctgactgcaacctccacctcctgggttcaaacgattctcctgcctcagcctcttgagtagctgggattacaggcgcccgccaacacgcccagctaatttttatatttttagtagagacggggtttcaccatgttggccaggctggtctcgaactcctgaccttgtgatccgcccgccttggcttcccaaagtgctgggattacaggcgtgatgcacttttaaactgaagccacgaagtagggcagcacagcctgctgcaagggaaagttcctcaaagggggagaaaaaacattggcttgatagcaaagattataaacctaaattaatgaaatagctagaaatagttgagcagaggttggcggcattgaggagtgctgcttcccacactgcacccacaccctctcaggatggctcacacactcatcccagcgcacatttacataacacttcaccgttagaaagtgctttcacaaccattttacagtttagaaagtgctatcacaaccattaacttatttaatctcttcctgcttgccctgaagctcaacaggccctgaaatgaatttacccagagctggatcataaaaatattcatctctgtttgcctgcatctcccttaccaggcatggggctgtcttaatggcaaggtggatggctccactgccatcaggctggaaatgaatcagggactattcatcatttcttgggttctgtccccaccaaacactgggtgccaggggctaatgaacgagggagtctgatccaactgtaatttggagctctgggctctgcagccaagtccccgctgccctggctgggacttgggagagtatcgaaggatgatgcagaagaaggatccaaagtgagttttgagaaaaaaatcttcacattcttcttctaaagcctaattgtgggggtaagggagagtccttgggtgactaagggctgaagatctccatcttcagaggacatgttctgcaagcctaggacatgcacagagatgagacgggggatgaattatgccaaacctcatggcaactcccaagtaaaaccaggggaaaccaggttaccgtgtatgtcaaggtcacccaggggaatgacttaggagtcaaaaagcatggatcctactgcccactgtggtgtcaagttgctgttcacccttgaacaagccttttgccttctctgatcttcaattattttatttgtaaaaggaggaaagttggtgatttgatttctgtgtgtcttctagaactgaaattatagggctccatggaaggggagctaagggaggagatatggaaaagtggtttgaatggtgggctgaagaagagggaagcttctgtttgtgcactgtaggtacaggaatctcagtaccacaatcttcttttcatctcccgatgactctaatcaacccccctctctcctctcactctgtgtctgtctctgtgtgtgtgtgtgttcatcctccctaagagcctcttggatgcttcaaatgtagaaccctgagagattgccccagttttcaacatgacaggtcagtatacatggcaagagctttggagcaagcagatattgattcaaatattccatcctcactagctgggcattctccactacttctcccttctgatccattcctgcaaggagggatacggctacctatcttgcagggctgttgagaggatgagatgagatgcataagaaaaccacttaacacgtggaagcaccttaatgggtgacagttattattaaataataataacatttaagtagtcagagaatcaagacactgacattgtccctccattgtccccattgtattccataggggctgccaaggcaacaccagaaatgtagcttcatcatttatcccttcctccccatccctctgcaaaggggaacaggcttagagcagaagcctgggagtcatgctccagacacatgcttaccagctgtgggagtgtgagcctcccaagccagtatttcctgtgtttgtgtatttactcattcacttggcaggcatttgttgggcactgactgtgtgctggaggggtgcttgtaagccccaatgttgtaacaaggatgtgtagccccagctctgccagcctcaagggttgacatgaggctctgaggagatgatatctgggaagcacttggtgggattgagcattgtgcattattattgctattaatgaagttattactatagtgatacacaaggcggggtataataaagggtagataagacaggaatggccagagagactgtggtgggaggggcttatttagggatccagctccatgcaccagtaggactcccagctggggaggaatcaggcagtaggttcgtgcccctggaagggcaggaacaagccctgatattgcacatcccccatccctagtggccaactagatgccaggcacaagggggttcccagaaaggatggaagggagagatggctgtggcagctgtttcagctgagggaacagcataaatagaggggtacgggcaggaatgctctatgcatgtttggaggaacagactcccctgtggtctgaaggagtctggatgtccaggagttcctaagggattgtgtcattttcagaaacaggatcttccacatcccagccactgtgaggcctgtaaggtgccctttcacagcaagtgtccagtgttcagcaatttgatccaaggtgcagtttgaagtggttgcaatgcatgcttcttgctaattgtctagctctgttacaccatggaatctcagtcagtaagacaccagagctaacgaaactgcctatctgaacacttaggaaaaaataacgtagcatttccaatcattactacatttcaggcattgttctaagccttttattatatattagtctatcatcacacccattttacagataaggtcatggtggcatacagagattaagtgaattgtctaaaatcacgctgctggtgagtgtcagaggtgggatctgaacctaggcacctggattccaaaggccaccattttaactgctacagcatattaccctggacaaaatagatgtggttccacttgagcttacagactagtggtggagaggttcagagattcaaaatcattgacaaaatcaattttaaagaagacaagtgttgaaacagcgattagtctgagcgactctttttggatagggtggtcagcggaggactctttgaggagggagcatttgagtgagaggtgaagagtgagaaggggcctcggaagagtgtccgagggggagggacagcccgaggcagtggaaagcttggcgtgtgagaggagacaacggaaggctgagtgtggggtgcggtgagtgaagagggtgaagaacacgaagtgggagtggttctgatctgacagggctgccaattcccaatcagcagctgattagaagtcatgaactaggagagggaaagttcaacacagggaattagcccacagcaggtagtaatgggggtgaagctgatgtcaggggaaacccgaccagctacataaagcacacacagacacaagccacaaagcagccccttacagaaatggctgattcttgggctagaaaaggaggatgcaagataagcctggagcatcttagcttcctgcagtgtcagagagcaaggaagtgtgcaaaaggaaacccacagtgatgaggggatgtcaaagggaggcaggagccaactgaaggatctcccagtggtcaatgctcaaacaatttgagcaacgtgataaataaaagagtattaaattataatccaaattatagaataaatgtccatgagcctatactgatataaatatgtgattgaataaataaataaatgagacaccacaggcacatctcacatgcagaatttcaaataatttatacagatgctctgcccttaagaaggtagagcatggctgactctgagaacactgcctgggagcaggagttagccctgctctgcaaggagcagcaaaaattaaaaaaaaaacaacaaaaaacaaaaggccgggtgaggtggctcatgcctgtaatcccaggactttgggaggctgaggcaggcagatcatgaggtcaggagattgagaccatcctgactaacacagtgaaaccccgtctctacttaaaatacaaaaaattagctggtgtggtggcacgcatctgtagtcccagctacttgggaggctgagacaagaaaattgcttgaaccagggaagcggaggtcgcagtgagccgagattgtgccacggcactccagcctgggtgacacagtgagactctgtctcaaaaaaaaaagaaaaaaaaagagaaaagaaaagaaaaaaaaataaggtagaacataactctccaactccccactccttaagtgtgggctacacatagtgacttccttccaaagagcatagcatggacagggggagggaggaacgagtaatttacaattgagaaatctaacaagcactaccattgccaggtggccaagatcagcatccagagtgatgcgttgtgagaacagtatgcactctcccttggtatgatgtgaggacctttgtgatcttctccccaaaacctcataaccccagtctaatcacgagaaaaatatcagaaaaatcccaattgagggacagtctacagaatacctgagagtaggccaggcacagaatacctgagagtaggccaggcacagaatacctgagagtaggccaggcacggtggctcacatctgtaatcccagcactctgggaggccgacgtgggcggatcacctgaggttgggagttcgagaccagcctgaccaacatggagaaaccccgtctctactaaaaatacaaaaaaaaaaaaaaaaaaaaattagccagacgtgatggcacatgcctgtaatccaagctactcaggaggctgaggtaggagaatcacttgaacctgggaggtggaggttgtggtgagccaagatcgcaccattgcactccagcctgggcaacaagagtgaaactctgtctaaaaaaaaaaaatacctgagagtaatcatcaaaactgtcaaggtcatcaaaaacagggaaagttggagaaaccatcacagccaagaggagcctaaggggacgtgataactaaagccatgggatatcctggatggaatcttgaaactgaaaaaaaaaaaaaaatcccacaacaggttaaaaactaaggaaatccgaacaaagtatggatgttaataaataataagttatcactattggttcattaactgtgacaaatgtaccatactaatgtaagatgctaagaataggaaaaactggatgtggaggacatggaaactctgtactatcttcacattttttccctttatatccaatgctattctaaaataaaaaagtttgctttaaaaattccactgactgggttccttcagtggagagacaaacagttctgtactctttctcagaatctatgtgtctccttgtattctaaaataacacatattcattttgaagtttataattttgaaaaagtgacacttttgaactaattagtttcagagagcagggatgaatgtaatacatttagaatgatgctgaagacttctttagctctcacaatggttaaaaagtcattgatgcttagcgataatgttggtgtctctgttccagctataacaaaaatactttagactagataatttatatagattactgaattttatttctcacagttccagaggctgggaagtccaaggtcaaggcaccagcagattcagtgtctgatgaaggctctctctttgcttccaagatggcggctcttactgcatcttcacatggcggtaagggtgaaaaagggttgcttccctcacagtagtacagagagtactctttatacaggcaccagtcccactgttaagagtggagctgtcatgtcctaatcacctgttaaaggcctcacttttttatactattgcattagagattaagtttcaacatgaatttggaagggacacaaacattcaaaccatagcaactggcttagcactgaaagcgcaggcttggcctttagacagacctgggtttaaatctcatctaccagctgtgtggctttggataaatccactcaatctctcagggccttgacttctccaccaacaaaacgagaataaagtatctgctttgtattcaatactttcctgaggattaaatgaaataaaatacatgaagcaccttgcaaaagctgcaaggttcctggcccctcatatgcactacataaatgacaacttccaagaaagtcatgttcaagtcagcaccctgccttggatacgattggagttgtctaggttacttaaaatttaccagcgcacaaatcacccaaggatctggataaaaggcagagtctggttcaacaggttgggggttgggggtagatgccacatctctcacaggtttccaggcgatagtgacgcgtagcgacactgctggaccggggcccctgctgagtagggaggaactcggctgtggagctcgttctgaccaaaaccacatggtgctcttgggcaagcgaccttccctcgctgaggcttactctcccacctgtaaaacaaaacaaagaaatgcaaaataaaaacaagaactatttattttccaagagcatagatttgtttcttggtgtgatacgactggtccactctgggagccagaaaggcaactgcaaggtccactgcctctaggggtttctcagggggtgactcagtttcctgcttaactcccctactgcttaaggtttataaagatcatagtgcggacctctaaaagacttaagggaaaacaaaaaccaaaacaagaaaaacttctaattttacggataaaactaaatggaacaaactgcattattttcatctgaattcctttcctcgtggctcattttgacacggagaaaataaattgccatctaccccccaaaccagctgcttccagtcagagcgaatggatcatgatttaatgaagacagccatctgttacagggtaaaatcctaattaagcaatatatgaatcagaacaaaattagccatcaggtcattagacttctgtaactgctgaaaggagcgtggagtcattaccacgtgaggcagtccttctctaagcaccagactgcgaggagaaacccatccctcccctggaatgctgcagcccaaacaggaggggttggaaggtcctgaggcgctaattgaaataaataacctgctttcagagaagccctggtgtcctacgtaatgaatgtacctctcgtctgtccaacatgtcacagtttgacagatgctttcgcacctaggaggacctgaaccctcctctgctaaccccttgtgtaggtctgatggtgggagctgtaggtccagcgactcgctcaagagaccacagccgaaaaggagccaaggcaaggccagcatccaggtgtgtggcttccacatcctgccaccgacactgcctcctcctcgatgaatgtccccaaggagcgtgtgttatcccaaattaatgagagactctaatgactgaagctcttggctctgcaagattggatgcctctctgaagctttcagatgctagggggatgactctagcacactgcaaagctgctggaagtgttgtgcaccactctctagttggccagaggaccagctgactaaaagaccctggctgcctttcactgctgttccagtaacgctgatagctctgcatcctgcacatagtaggtactcaataactaaatgtcgaatgggtgaagaatacgtgcacatagtaggtactcaataactaaatgtcaaatgggtgaagaatacgcgaacaaccttgacgagtccctgcatccctcttaactaaccctcaggactctagagaaaaatatttagttgttccctcttgtctataacataaagctctcaatatatcatctttatcaaaagcctttaaatagagacaagttgtatcactagacaatgccctctccaaacccacaggcaaagagcagaaagctttctgctccatcccttgccagccctgggactcttctatggtcacagctttgctagggataaatggtagctcatctttatttcagcttacatgtggtttgttactacagaggaggggaggtgcattttcctatatgtctccctactaattatgcccctttttggaaattgtatcctttactcatttagttacagaaaactcagtttttcttatttatgtgtttgattttttttttttttttgagacagagtctcactctgttgtccaggctggagtacagtagcacaatctcggctcactgcaacctccacctcccaagttcaagcaattctcctgcctcagcttcccaagtagctgggattacaggcacgtgtcaccacgcccagtaatttttgtatttttagtagagacagggtttcgccatgctggccaggctggtctcgaactcctgacctcaggtgatcctcccaccttggcctcccaaaatgctgagattacaggtgtgagccactgtgcccggccatgaattttttatataataaaaatattaactctttgctgcaaatatttttcctactatttttctcctctccccatcccacctccaagtgcagagactttaaaatttgctgacgtcccttctgcccattgttttcccttgggcttgtttccagtgatgctgtgcttagcaagtcttttctccctccagatgtttgatagatattcaagtctaattcttctggtggtgtacggattgtctcacacttacctaacctctgtcatccacctggaatgtgttttgatatgtgatgtaagaagcttttctcttggctccctacttcttcattctccacgtgaccgcagagttctacacaagtgtaggttaaagctggacacagttagacgttgctgtgagcctgagtgcatcctgaggttttttctcaggtatgttgattgaaagtgtctaacattagacggccccaggaaaggaagtcttagtcatctcagcacaagtggaagaagaaacaagatgaggagttaactgtgttgtctttaggtcctaaacttttactcattatcgaaattcagatccagggtcatttttcctgggaagcctttcttgtgatgcagccccagcctgggtttgctatctgctctttgggccccacagtgttcttgtcttacctgcctatgagtacccacaagggatggctgctatcgacttggctgattctgctttgttcccctcagggaagggaccttgacttctcattgatttgctattgtttctccagcccctagcacagcccttgctcatagcaggccctcagtaaatacatgtctaatccatgtccaaactcatgaataagtggcacctgagacgtccccctggccacccatcatgcatggtaagcatcctctgacgctgtctcatgaacactcacaccaactaggagggcactgataactattgcatttacccaccaggaaaccgaggctcagagatgtaaggaacttgtctgccgtttctcagggctttagtttatgatgattctgcacatcctcacattattcagaacctgcttgttcagttgaggacattgaggcccagggagaggcacaaagtcacactgtcaacatgctcttaggcagactcatactgcatatggaactgggatgcttcagggatcccaaaaccctcgtctctctcctgctgggcttctagtgggccatgcccatggtcttgcctgtgattggttctcagaaaataacgattaagttacactgatttgaaccatgataccaacacctactagtgtgtctatgaaactttccactcttccaaaacattcttgctcttactgtcttggatccattcattctgtcgtccttggacatagataaagtccaaggatatcagccaagcatcttgcagggctgtttaaatcactagattctcaactgcaattgcatgtgcaaaaggagaggaaattcctgaccttgaaaaatctgtgtccacataattaattttatgtgtcaacttgattgggccacagggtgcccagacctttggtcaaatattatcctgagtgcatccgggaggatgtttctggataacatttgaatcagtagacttagtaaagcagatagggggtcctcatccaatcaactgatgacctgaagagataaaaaagtctgattaggaggaaactcctcctgcctgagtgcttggactgggaccctggtcttttttgcctttctgacttgaactgaaactcagctcttcctgggttttgcacctgcctgtcttcagcctggaatgacaccatcagttctcttgattctccagcttaccaactgtagatcttgggacttctcagcctctggacgcatgtgaactgattcctcataatatttacacacatatatgtcctgttctgtttctctggagaaccctgactaatatgtccatagaaggagatggtgtctccagtatcaattagaggaacatgtgcttctcaggtgacacctgactccctgtgctccatgattgcggtttacaaagcgtatccatggacatgaagtttaatttacacaaaaagcttaggaagaaggaattggtattctcacatttacagatggggacattgaggcccagaaagctaagttacttgcccctgactgcatccattttctaactccagttctttctgtgctctcttatggggtgtgagctggattcattgtcttcctcacgtgtggcagagcctctggggaacacagccacatcaagggtcttggttcaaaaactgtcccaagatgtagaagtctggttttgtacctgatccaatggacgcagttcagcaggatagaaagttaggaaacagtaaccagaaggttgtggactggcttcagggatgcaaaggtcctgggtgacaacatggctcaggatgcagctgaacttggctgctgagctagaggagagtgaagatcattcagcatggtagacatgcaagagactgtggtaggaagggagaaagaaatagggaatggtagggatggtagtgaacaagagggcatgcatgctcaaagacatcttgccgagaccagctcagtccgcattagggagagaccctaacgcagcggcgctagaggaattaaagacacacacacagaagtatagaggtgtgatgtgggaaatcaggggtctcacagccttcagagctgagagccccgaacagagatttccccacatatttattaacagcaaaccagtcattagcattgtgtctatagatattaaattaactaaaagtatcccttaagggaaacgaagggatgggccgaattaattgcagcaggagcatgtccttaagacacagatcactcaggcttttgtttgtggcttaagaatgcctttcagcggttttccaccctgggtgggccagatgttccttgccctcattcccgtaaacccacaaccttccagcctgagcgttatggccattatggacatgttgcattgctgcagagattttatttatggccagttttggggccagtttatggccagactttggggagcttgctcccaacaacatccaccttattttatggaatgaatgcttgtgtattagtctgtttttatactgcaataaaaaacttctctgagactgggtaatttataaagaaaggaggtttaattgactcagttctgcatgattggggaggcctccagaaacttacaatcacagaggcaggtgaaggagaagcaagtatctccttcacaaggcagcaggaaagagagagggagtgaagggggaagagcctctaataaaaccatcagatctcatgagaactcactcactatcacgagaatagcatggagaaactgcccccatgatccagtcacctcccaccaggtccctccctcgacacgtggggagtgtggggattacaattcgagatgagatttgggtgtggatgcagagccaaaccatatcagcttgcatccccccagaattcacagggcaaagccctggcccccagtgtgtctctatttggaaatagatcctctaaggaagtaattaaggttaaacaaggtcatgggttgggggccctaatctaataggattagtatctttataagaagagacagagctcatttattttccctgtctctctctctctctctctctctctctctctctctctctctctctctctccctccccctccctctccctctccctctccctctcctattcctgcgtcccctgcatgcacacagagaaaaggccatgtgaggacacagcaagaagatggccatctgcaaactagagagagcaccctcagcagaaaccaatcctactgtcaccctggcctcagacttacatcctccaggactatgagaaaataaatctcttgcttaagccactcaatctggactattttgttatggcagcctgagctggctaatacacattcctatttaaaaacaaataaataatgtgtgcagggctgattcagccagtggcaggtttgcagcctgtaatactcaaaggcattcatagtgcagcgttcaggtgccagagtgctctgtaaataaagaagaatgtctggggttttggagacaacggcaggaaggaacagcataggactatctggcctgaggatgtgatcctgaaagaacgggctttgtatgtgaagctgaagaaataatggtctaggaggagcagtggggattaagaagaatttcagcctgtgtctgtccctcatgtgagaagaagcctgtcaggaagtggcacccttggaagacagccaagcctcagcagggaggatgaagagagctgaatgagaggttcaggatagagaggtgatatggtttggctgtgtccccacccaaatctcatcttgaattgtagctcccacaattcccacgtgttgtgggagggacctggtgggagatcattgaatcatggggccagtttcccccatactgttctcgtggtagtgaataaggctcatgagatctgatgggtttataaggggtttccacttttgtttggctctcactctctcttgtctgccaccttgtaagctgtgcctttcatcttccaccaggattgtgagtcttccccagccacgtggaactgtgagtccattaaacctctttttctttataaattacccagtttcagatatgtctttattagcagcatgagagcagagggcattcctgctctacagctgggattctggaatgcacagtggggaagggggcaggtaggagagcagaggaaatttgggtcagggagcaacatgaggtggtagaaaaaactgggtgcctggaggggtttccactggggatggtgaccaagcaggcagggctgagaggcatggagaactgacctgagcccgcggtgagtaggtgatcctacaccagggaggggcagcttctcctcctccacttctggaacagcaatcagatagaaggccacattagggtctgggccaggatggtgtaggaggtggcagagtgaacccagtggcaatgcaggcctcaaatcccatctctgtagcaccgatcagactcaggaaggcctacggctgtgatgggtcaggcgtctggagaaagcaactcgattctaaggtgccacctggtctgggtgaaagagagcaggtctgggttggggagaggcagactggagagtggggcttgcagaaggcagagccctgatgaaccagcacccgaatgaatggattccagaaaagagctctagttttattattgctgtcagtgatttccattttcatatgttaatccccaattatgaaacacttaaaacacacatagaaaagtaatttaatagcatattctctttgtcgaaaaacgttgcagatgttataaaacctttgcctccgtctccccagaggttgcctctgtatcgaagttggcatacagtcttcctgcccagactttcatggtttaaggataaatacctaaacaatttacagcactgtcttacgtatttttaaatgcacgtacatagtttcaaactgcatatacccttataagtttttaaaatcaatgtgcacatacaaataaccactggcaggcccagggtttttttttttttgagacggattctcgctctgtcgcccaggctggagtgcagtggcgctatcttggctcactgcaagctctgcctcccgggttcatgccattctcctgcctcagtctctcgagtagctgggactgcaggcgcccgccaccacgcccggctaatttttttttttttgtatttttaatagaggcagggtttcaccatgttagccaggatggtctcgatttcctgacctcatgatccgcctgcctcggcctcccaaagtgctgggattacaggcgtgagccaccgcacccggccacccagggggttttataggtgaatgtttacagtattgcaaggactaggaaatccctcattgataccagtcctgccagtcttgtcaatataacatcgagacctgagcagtctcccaggctgtcccctttgacattagagatgtctccaattactgaaaaagcaacgctcaagacctgtcccaacacaatcgcattaggttagtacgattcctgactcgagatcattatctaagctgtttcctcttccaggaacactttttctgccatctgtatctggtgaacttgcctgtgaaggactgtgtccctttctcataaatctccctgtctcctctgctcttgcctcatgagcaaaacggaaccctcctgggcatggggctcctgggatgaggaatagagagcatttctttctgggttctttccttggcattaccaggagaacgtaggttccacaaaggccacagtggtcccattttctgaaggtcagggacaactccaggaaagtgtctgacttcgagttctgcctttggacactttgttagacactttgttaactgcagagtgcctcagcgggacacccgtccaaggtgagtggcatcttcccttcttaattgcttcctgcaggcttttcttaactagggctgcagacagatacagacaacagcttcttgacaccgcatcagacccactgaagtagtgggtgacagacagacccagttagatcatggtatttttagaccccagcttgctggaaacctttccccctcaacccccagttgtgatgtgtttctgataacctctgttcacgctgaaggactaaagtgtctatatctgtgtgtggaaaaaacagaacattgaacccaaaggaagtttctaggccatcttcttccactctcagacatctcaggtgagaaaactgagctcagagaggcctcctcccaccagccaccttccatcccaattgcctgcttggtcaacagagtgatctttcaaaatacaacactggccctgtcagctccctgcttaaaatccttcaaaagttctcttttgccatctggatgaagtagggcctctgctctcagtacaaaaggcccttatctggtccgtgcatgaatactttgcacactaactgcccttagtgcacttcttcaagcaagacgcacgcctccaagcctccctgcgtttgctcttgctggtcctcctgccagggactccatccctgcacctgttcattcacccatcctttcagacaaagcttgaaggccacctcttcctagagctgtttcctgaccgcatctcctgggatgaattgggtgctccttctctgtgcctctgtgccatttgacacagtctgtatgatggctctggtgttgaaatgtctgtttcatgcctatcataccccttttatctctgagctctctaaggacaaggacttgacttttcaactcaaatattcctgtgcttttggcatacttcacactcagaaaaagtttgtccaataaatgaaatgagtgggtgaatgaatgaggaaaccccttgttcaaggttttatacaggtgagcacagaatcaggatttccaggccagtgtgagtcccaccatctttaatgcctgattaaaatatacgctaactctgccaataaaattatgccattgaatgccttactgggattgtacctacatcttcgaaatacagaaaaggctttttagccctaacaaagctgtcttactgccccagcttggctgggagctcagctgtggaaagtcggcagcttcaactgaggccattaaaccgggcattacctgaagccacgtgccggatagcatcagtcactcagctggttttcaagctttaaggacagaaatcgcgttatctttatgaacctcagagcagtgcaccctctgttggtcatatctggaattgcacagggtcaaggtttgatcctgtatttggtccgggacacagcagttctgtgaaatcatccactcgctcactcaattcattttctcgttcatccatcttatagacatccattgagtgagttccatattcccgccatggtaccacgggtgggtgtaaatggtgaatgagaaagtcacagccctccattaatggtgttgataatctggcagggaaagcaaaaattcaacaatctatttcaagagtagtgagtgctcttctaagtggaaattcaggatgctaacaggacactaacagggaaattcgggacgctaacagggcctggagagctcacctgggcggtgtgggaaggtgggcggcgaggaagaagtaacgcctatccaccccacctcatactcatctagcggctgttacatgccagacattgcgatggttctgggagacaaaaaccagagtctagtggcggaaggagggcaggagaccccaaggcaattatgacagcagcggcaacaaaacaacagctattacgcattgcgcagctttaactcataagactcctgtgctgtagatgtaggtctacaccgcggacgttggtctgtctgcatgacgtagatattatgaccttttttttttttttaagacggagttttgctcttgttacccaggctggagtgcaacggcacaatctcagctcactgcaacctccgcctcccaggttcaatcgattctcctgcctcagcctcctgagtagctgggattacaggcatgagccaccatgcctggctaattttttgtattttcagtagagatggggtttctccatgttggtcaggctggtcgcgaactcccaaccttaggtgatccacctgcctcggcctcccaaagtgctgggattacaggcatgagtcaccgcgcccggcctattatggtcctttttgaggggaaagaaattgaacctcctggttgattccaccacattatgcccctctcactacattatccagcctctccaacctgagtaagttcaaaatagaagtacatccggggcacgatcttcaccaaaccccatgctctggggactgccatgactctgcaggtgagagacccaagacatggtgaggtcaagagccttgcgccaggtcccccagctgtcaggagagagctggtctagagtgaatggtcaggaaagagagctgtgcagtctcactacctgacactcgccaggtatgttagttcgttgtggcattgctataaagaaatacctgagactggataatgtatgagaaaagaggtttggttggctcatggttctgcaggctgtacaggaagcatggcagcttctgcttctggggaggcctcaggaagtttccaatcatggcagaaggcaaaggtggggtaggcacatcacattgcgaaagcaggagcaagggaggtgagggaaggtgccacacgtatttaaataaccagatctcatgagaactcactcactgtcgcgaggacagtaccacaggggatggtactaaactattcatgagaaatctgccccgatgacccaatcccctcccaccaggccctaccttcaacattgggggttacatttcaatatgagatttgggtggggacacacattccaaattatatcacctggcgtgtgacctttgggccagtgacattttctgtgcctcagtttctccactacctacctcatgaaatggtcttgaggaaacaaaacaatacacttttagagtctggcacattcagccttcaatatgtgttattcattattatcattactagctcttataggggggatatttttcccctactccttatgtttccatgtggaaggacctccactagggcgacacccttggtctctttctgccacacactcttcaccttactcacaccttcccaagaaaggtggcagcatttaccgaactggtgagcctgggagaaggaactgggcatgttgggatcagccctttctgggtcctcttttagagctgggtaggcacaggtgtctgattcagaggtaaaattttagggacccatgcaactaagccacttgccccaaccttacttttttcaacggaggttttgtctcccccgtctgcctgatgcctctgcccttttcctgtcatttatcctgaacatgggtggggaagagaaactccaacattagccagaagtgatacccagtttcctttctgcaatttctcattgtgcttttgctgcttctaagggttttgtgtctctggggtagaaaaggaagaaaacctttttcaggctgaagatctacagaagtctggacttggacttagagtagaccttgagagcctggacatgactggcagtaaacagcccaaggctgtaattcctcagaggatggaactgggatcccagaaaggcaggtggtgaagagtgaagctgaatgcagctcacagatcctgcctgccaggccgggcctttccccagaggtgcttccctcgaccacctggggggctgcaggctttccttggctttaattggtggatggctcacctggcgtcagacattcaaacaattattaggtaattaatgagaaaggggtactagttgtgagaatgagtaagatggggaaggcaggggcctcagtctccaggggtccagctcccccagcccaggccctggtgtgcagggcacagccttgcctgctgtgcacaaaaggaggtaaggccctcattgctattcaagctgtgttcctctcagtctctcatgatgaaatccctgtatagaaagcgaaatggatctctggctgatctgaggctcccagcccaggcctaccttgcacctgacaccagtctcagggagtgtgtgggtggcacggctgctctcctgacagaagagccctcctgagtctggcccccatctactctccagctgcttgcctgggccctgtgctcctgcccactgcacagcagacgtgggcaccaccagggctctgccgctttgctatgctcttctctctgtctggagtgcccttcctccccctgggcctggagaacttagaattcaccaccaaggctcaatgcaaatgtcatcttttttataaaaacatttctatccttcctttgtggttctccagcaagcctctagtataacagttttcatttcgttgaagactctaaggctcctgaccctatttagctacaagtgtgttttgtttggccagcattgtgattttagaaaacttaaaagtaggtagagcttgtacactccagttcaccacagaaccaccactgccctgttgtattacaccatgcctatcaggtattttgatttttcgccttgaccctgaaggcttttgagtttgcatccctgttgaagagcctggctccagaagatacagttttgaaggaggttgttcatagaggtatactcctgtatattagggttctccacaggaagagaaccaacatggatatgtattagaaaagaagtgtgtgtgtgtatatatatatgtgtgtgtgtatgcatattgtgtgtatatatatacacatatatatgaattagataactaatgggaatttatatttatatatacatatatacatgagttaggtaattaatgggaatatatatatatgtgtgcatatatatatgtgtgcatatatatatacacacatacatacatggctcacatgattatggagggacaagacccaagatcttaaattggcaaactggagacccaggagagctgatggtgtagttccagtctgaatcggaaggcctggaaaccaggagggctgatgagtccaaagacctgtaggcttaagaccaggaagagtcaatacttcagtttgagttcaaagacaggaaaaacacaatgtcttaactctaaggaagtcaggcaggaggagctccctcttactctcaggcacgtcagccctttggttctattcaggcctttgactggttggatgaggcccaccatattgggagggcaatctagtatactccatctaccaattcaattgctgttgtcatccagagacacacttacaaacacacccagaacaaacacacccagaataatgttcaaccaatgtctggacacccggtggaccaatcatgttgacacataaaattaactgtcacatcccctgagattcctgatatggttttgctgtgtaccccccccaaaaaatatcatcctgaattgtaatcctcataatcccctcatggcaagggcgggaccaggtggaggtaatcagatcatgggggcagtttttcccatgctgttcttgtgacagtgagtgagtcccatgagatctcatggttttatgtgtctggcatttcccctgcttgcactcactccatcctgccaccctgtgaagaaggtgcctgcttctcctttgccttctgccatgattgtaagtttcctgaggcctccccaacaatgtggaactgtgagtcaattaaacctctttcctttataaattacccagtcttgggtatttcttcatagcagtgtgaaaaaggactaatacaattcccatctcctggttattcaagcaaacatgagtctaggtattgttgtgagggaattttgcagatgtaaatgagattagaaatttgaagacagggagattattctgaagacagggagattattctttcccaagctaaccacatgagcccataaaagcagagaaccttctctggctggagacacaggtgcagcagaaagagaagagagagcctaggcctgaggacttggcacatcgtggctggttctgaggtgcaagtggccaccacatgcaaggcctggggagaggcctgtgggagctgagggagacccccagtcatggtcaacaaagaaatggggcctcagttctaccacagcaaaggaactgagtcaggtcaacaacctgaataagtgcagtagtgggttcttccccagggactccagtaaggaatgcagccctgatggcccttgattttagctcagtgttagatttctaaccagcagaaattgtgagataataaatttgtgttattttaagttgctctgtggtaatttgttacgaaaatagaaaatggatacagggaaagtccatgcctttttcgtttttagcttccctcccaccttctcaaagtctggcacatagtaggtgcttgccatgtgtttgccaactgactgagaggcaaatcacaagggatgaaacttagccctgcttcccctcagagaacagaccttatgatttctatttctgactgtatgtgcggctcaggataggagaagctgattgacagcaagttgacggacagcccaatttaaatctccagtcaggaaaaacttgggtgaatcattgttttctgcaaaaaatgacacttcagtatgtatgttccataatttgtggagatgggttccagtttaaagagttccttagtgaagaaaaaaaaaccatgatttatcttcctaaagctttctttttcttctcctgatgatgacaaatgtctgcagccccctcaggggatgatgggatgaaacgcacaccattggtcattgtgacagaacagcctggaccccccagaaacttatggtttaggaagaatggcatgatgcccacaagcaactgtagcacagcacagagatgctgtaggatggagaacagcagagcagggagcacgggacagcagagaacatcctgaaacaggagacagaaaacctggtgtccactcctctctttgttgcataacctgagtctcagttccctttttaaatgaacctcctctgtttctttcaagctctgggatcagaaaatattacctatgccaaagagttctgaccttgactctactgaggccccaggaaggctcaatctgacaatatggtacctattcatatgttattttagccataacagcatgtatgcatgtatattggaatattacaaacatgaattataagctaaaaaaaattcaagaataggccgggcatggtggctcacgcctgtaatcctagaactttgggaggccaaggcgggtggatcacgaagtcaggagatcgagaccatcctggctaacatggtgaaaccctgtctctactaaaaatacaaaaaattagctgggcatggtggcgggcacctgtagtcccagctacttgggaggctgaggcaggagaatggcgtgaacctgggaggtggagcttgcggtgagccgagatcgcgccactgcactctagcctgggcgacagagcaagactccatctcaaaacaaaacaaaaacaaaaacaacaacaagaacaaaaattcaagaatacagaaacatcaatagatatttccctatcacctccaaaatctaactggaaaagactctacacatcaaccagccagtggttttctaacaacaacatttaatgttgagaaaccccttcatccggtcatcacccagcagcattcccacaagcactgaggaagaaatgcctcaagctctgaggggcacactctgaaaatctctggtgtagcctattttgaagagaaagaaacaggcctacagaaggtcaaatgatttgtacaaggtgaatggcttagtcagggcttggaccctgtgtacttgaccccaagaccagtgtccaatccatgacactacttcccaccatcacacacaacgaggaagataagagtgttgggtaggacagcaactcaattttcacgctccttttccctttattcacaggcagaaagagacagatgaaaatgtggactaggtttattatccctcagcatatgttggttttaataagtgtgttctttgtagattcattaatccactgttagaaaccgaaaatgagtatttcagatgcttaatgtgatgtcctagatgctctgagactcaagtcccctccagagagagtgttctttaatcttcctaaatggtccgtaatgaaacctgtgggtctgtaatagggaatatagtccgttatgacttattgacaagattttctaaaaaaaaaaaacctcattaaaaaagtatcccaaatgatatcactgaggcttagtctctttattccatgatgacattttgaaatgtaactttaaatggttcctcctttatatatatacatatataaacaaacaagagggattttgacaaaatagcaatgatctgattttaacgtatattttagcaatacaatttaaattatctgtaatggtttataattaaatcctatatactgttagaattgtgatgaaccttagatattacataatttgcatctgtttttagaaaagaagatcccgagacagcaaatcacctttccagcgttgtactgcaagtttgagatatacccaaaacaaaaattcagctctcctgatatgcagacctaggttgtactgcaagtttgggatataaccaaaacaaaaattcagctctcctgacatgcagacctatgtgtcattcatgaagctatgcttcagaactggcccagtgcaattctaacttcactgtggtaaaattacagcttttcaatagtaataagaaaaaggaaattctttatttaagaaaataagaaaaaggcacccaggggagcagtgaggagcatagcctttgtcataagaccctataatctcggggcagttacctacctcttgaagtctagcctttctcatttgtagaatggggacaagttgtccaacatggtaggactattgtgagaattaagtggtccaaggtaggtaaagcatacagcacttggcatagtaagcattatttattattattattaccttgtgaatttttatatatggtcatatattgtatacatgaacgccttcagagaaacttgcttctctctgctccagtttatggcaaactcctatttcttaacctgtcaaatcttggattttttaaactctgagaaaagcatatattcccttatctcccaagatatacaccctgtcagtgaattattttctgtgtttgaaattggaggctaaaagctatttctaaaggagcagaagagttggccaactcacttcagcaaacatttacgcaacacctctcttccattaggctgcgtaaaatgcagagacagaaacagatgtgattcctgccctccaggggctcccaaactggtggtaaagacagacatcttcaagtgtctctaatataggcattaatacaagtgttcctctagaaggacaaataaagcaatgtagaacgaggatgttatgaagtgagaggaattattctgactaggacatacagaaagatctttgaggaatataatttgatttaactcttaaagggatggtaggtcttgaacaggaattgcagtaggcagcttttaagatggtctccagtggtccttacccgctgatgtccacagcctcatgtaatcccctccccttgagtgacttgcttctaataaacaaaacactgcaacattgaggggatgtcacttccatgataaaattacaaaagattctgacttctgtcttgccagcagactgctttcaatggtgtttttgaggaagcctcttattacattggggtggcctatgtgccaagaaactgataaggcaatttgcacatcctgagctatgaatttgtggaatagaaattaaactcatgtgactggaccatgatgtttgtggagagatgcagcaggatatgaggttagaatgataggttatggctaaattgtgaagggccctcaatagccagctaaggattatgagctatactggaaggcaatagggaaccattgagaatcttggagcagatgagtaactttattagatagagttgctctaccaaagactaatcaaatgctgtatgcacaacacatcaaagggggagaaattagagacagcttcccgggggaggtagtgaggccctgaattcggaccctctgactaaagaaataaacagcagcccagaaaatactgtaatagaattctcattgatgttgaaggttctctgaacactccccagtttgtgaggcagaaactctatcaggtatttatttgacatccacctcatttccactccacacagtgacaaactcatattggaactgaaaataatcacaagcctgactctgtgaaaatgaaaggaaatgttcccaagatggagaaaggagctggtagggctgagtattttctcagcttcctggagaagacccatttataaaccttaacaagggtgccagggttcccaggctctgccttcttcacctttccatgttctggctccccacatccctaggcatccttgaaggaggattgaagggtgttagaaaccattccaatatttaaaaaaaaaacccacatagatatccttgcagttactcacaatattcagcacagtgaacaaggatgccaaatccctttggttggggctagaagtacaagcagtactacatggcagttctggatgaccaattaaaattcctggctggatctgtgcttttaattaactaaaatggaaaaatgaattaattgccacttcaaaattagagcatgtttagtggtggtagcttgatgtaatggtcagtatagcaaaatgaagttgctgtgttggtctgctgtgtgctcttgataagggattcctcagtgagattcaatttttgctccccaggaggatggggccaataatcattgcctttcaaggttgttatttggattaaagacataatgtatgcaaggatcctagccctcagtaaatggtggctatcttaaaaatagttggacaagatatttatacaatattctggcaaaaggggattggactgagaggagatctgtccgtggtcctgaaagtttgatcaccactgcttttgttctttatgccaggagcattggttcagctgacttcatttctgtcatggactttttcttcagccaagtttttaaaatgtttttctagccctgatgtaattgttcttctatctttttgctacagtaatcttttaaaggcacagatttagtagtcttatgcccttgacaaggtccaaacctctcccaaggcatcggagacccccaaaatagactacctccctgcctctccaccctcctctcccctcaattcccatcatatgctcatatgttcaaacctgaggaggggatcgtgggaatccccgatttatagccggttggccagaaatactggaggcctggacttaagagtggaatctcaagtcagggcagtcttgtgaggtcagtgtgggaaaaatctcacatgttctggtgaccagagatgttatgtgttgattgtgtgcctattatatgcagtgattttttaaaggaccagtgattaataaaggagattctataaaagcattccatgagggatcaattatgttgacttagttggacactaagcagtgaatggacaataacaacaacagagatcaatgggacacaaaataacaaaacaaaagaaatactgccaggcttggaaaagagcacaggatctgaagtaagaaggtctgagttcaggcttcattccaccagttcctaggtacgtgaccaagagcaagcacccaactataacaagcctgtttccgaatgtgaaaacttgcaatgaaaaaatgcccttttctatctacaccagagtgagcatgtttgggtagatgcttcttactaaataagacacaaaagttgcaagctaattattggtataagatgctgtgcaaaaatagctgagttaaagaaaataactcatcagcctttccctactaacctgcagacagagacactatcttcccccaagggccaaataagaaatatgttcttgttttcaatttctctttcccaaactccacaccaagccccgccattatatcatgtcaattcttcttccatatgtctccttctattctgaaaccccactctctgctttgagtggggttgtcaccatctccagcctggacccctgcagtgcatggtcttctaatccagaccttcccaagctttcatgcatgaagagttggccctctgtatctatgagttcatatgtgtgatttcaaccaacagcaaaccgaaaatattttaaaaaacaacaaaagtaacaacataacaatacaaatgatacaaatgtaaaaccaacacagtagaacaactatttacatagcatttgcattgtatcaggtaggtctgataagcaatctagagacgatttaaagtatactggaggatgtgcataggctgtatgcaaatactataccattttatataaagtgcttgagcatttgtggatttcgatatgctctagggtcctggaaccaatcccttgtggataccgagggatgacggtacacatcacctgggatcttgttaaaatgcggactctcaatcagtagttgctcaggatgtgtcctgagattctgcttgcctaacaaggagggccaatactgctgttccatggaccacacagtgaacagaaaggctctaaccggtgtccctgaatgtaatcttacacctgccacacaacccattaacttcactgtccccagagggatctttccaaggcagaaaactgacaatgttgtgcccatgcttaagacctgcaatgagaaggcagattcaatgtcaggattctcaaacctggctgcagatttcaatcccttgggaagctttaactaaccaaccagacagacagtgcccagaccccaggccagaccaattaaataaaactacccagaggtgggccccagacaaagatattttaaataactaactttccaagtgggtatgatgtacagccagggttaagaatccctgactaacaagggtcatttcagcacaaaaacttaagactcccccataatttaacactcacaataaacccaaatagattttcttattcccagatgaagaaacagtggccccagagggttgagtgcctcaccccaggtcatccagtctgtaagtgctcctcatctgagacctgagacccaaagctctccaccatatgaggggtggaagaaaaggcaaaagtgtgatgtgcaggagtccccagtgcatcatttcacgagaacatttccagttgttttcagcatctcttctatttattccccaaacccccacagcctttgatgaattctggaggagagaaactgcctggcattttcaaccaagtgctttgatacttgaacacagcagtggatggaaagtgacagcaccttatcagtcactgtgtcccagctgctgtcagagctccttcctctctgccaacagcgtgggctgggctccctggctcgcagagtggtgagcgatgcttccgcgaggagatgcggcatctcaaagtgcaagatgcacccattgcagctctcagcttttatgccccgtgatatttatcagaaggaaacaattaagtcccccagaacgtggaatctcccttggagctcatgggggtagtgacaaaaatgtatctgagcaaggcatctgggctgggaacctgccttaggacctccttctatgggacggcaatgggcactttacacacatgattccgttcaatgctgaatgcaatgccaggagctctgtgctggatccttacattgcagatgacaaagctgaggctcagaaggatgatgtgactcgcccaaggccatacagacaggtcaggcatggccagaattagcctgaggtcagacgccaaatctgtggcctttccaaagttaggctcccggtatccagcatggagtcccacatggcaaaggcacttgattaacacttgttgagtgaatgagtgaatgaatgaatgaatgaatgaatgaatgtcttatgccatgctgcactgaaagacaggctccattggcatctgggacaagcaatgtcaccttttctttgcctctgtttttcaagagtaaaataccagttctttaggattggtgttgggatggctggtagagatttattttcatttttgttgcctcagatgggtttaacttgctgttgttgagttcatgttaaagggaaataggtcccagggacagaggtccaggagctcttaggttcaggcaagtctcttccttttaacttcctgatgttgagttcatgttaaagggaaataggtcctaggggacagaggtccaggagctcttaggttcaggcaagtctcttccctttaacttcctgatgttgagttcatgttaaagggaaataggtcctagggacagaggcccaggagctcttaggttcaggcaagtcccctccctgccctgggcctttgggttcctcatctatcaaactgggagagtcggatgagatggagattgaaatcctatgccttatggatgttcttggatccagcaaacccagtaatgcttactgatggacaagcagtaaaggttttgagggttttctccccatgccctggttcatccccatcagagcacctctgcttgaacttggctgtgagcagcatgaaggaggcagaaccgatgttcagctccttccatgtccctctaggcatcatctgcctcctgccctgggcatgctcttccctcccctatggcaaagttctcctttgccaagctgccagcctggcattcagggccccatgtgtctgggcccaaccttccccttcagcagtatcttccatggctcctgtccctgcccttcatggcccagccagcctgagccacctgttccctaaactgccctgcacattcccacctctgcctctgctggggctgtgcccttcacctggagtgccatttccccagctccacctagggagaccctcctcatcaaacaccaccttccactaaggtccccaaatgctgcctgttccggcggcactttgtactacatctattcttcattcatgttttcactcacccactcattcactcattgatttactacctatcctctcagggagtttcttgagcacttgctgagtgccaggcactgtgctatacacttatcatatgtaacctactctcttcaactacctgggaggcaggtttcaaagttatccacatttcacaggtgagcaaacggaggcacagagaaatgaaagccacccagcacatccatagcagagtgtgtatttagaccacatggtttgaccccagatcccaagccagcctctctgtctggtgtctcttctgccagatcctgggctgctgcaggacaagggctgtctattcttgcacccaacattcattcaacatgcatcccttgagcaccagacatgcatccaatgcatccattgagcatagcatgtgtcagatgctatgatggccactgcacttctatgggtgtgatggggtctctcactctggtagggtgtctggcttggggcttggcctcatgaaggatcctttgagactccttgctgaatggcatggctggtaacactaggtgagggacagggttcatagcaaggtctgaggacagatcctttgatagctgcactggaagcaggacactgatgggggcagatggctgctcagaaacagggggatggggtagagctggtactcactgaaggtcagggaaagccgagttgagaatgaaggatgacaagcctcactgcttcagattggcccagggctgcccccagtgcttggattcagactggaaattctgcctgccacagaaacggggccaagactgtgtgcatgcgtggccagagccagccaactgtcacctccacttaggggccagcccccttcacagagtaaaactctggaaggcagacgatctggagaggttgacctggtgccaggctccctcctccaggcttggtttcatttgtgcatcaaagggaggagttgctgtctggctgttgcatcttgcaggttggtttcttttgaagcttcaggtgagagctccagaaatttccactgctccttgtcctagttaagcagaagccctgcaatttggcttaatgtagtgctcattcgctcatcctgttttatgctgggtgtggcattgggcacgtgaagatgtgaatgaagggtgagaaaaacagggccagggccctggagagggagacacacctgtgtgcagcttgctgtatccccaggcaggcaaggccacagtgctgtcattgatgaacaagacggcaccaggatgccctcaaacaaggactgaggggtccaccacatttaagcaaagcttctcagagaaggtgaaatttgagctgggctgggaaagagtggggttttgacagcctgagaaggaagtattaaggtcatttcaaatagtgtgcactttattctaatgaaaggactcaaatgcttctggtttgatggtggctctcacaaagcaagtgacagaaaaccctcttgctgcctcgaatcttcccccttccagggtttcctgttgcaaggaatgaccctgacactcacctacccagtcacctaagcacccttcacctcattcaacgaatttcccaggcctagccagtctaggtttctaatgaccctcaaatgtcctgtttctctgtttgccgcccccttgactgctcaaactaccagtgattcttcaccaggtcactacaacaccctctcagttccaggcagagttcattgtgctttcctctgggttctcaaaaacacttggcgcttatttctcttattgacatcatcatgtggcatttcacagtattttgtgtctatggatgcttcattcctttatcccaagcacagcagctgtcgcataatagatgcgcagtaagtgccttttgaaatgttgggttggagctgcctctactgtcagtccacattgtgttggctttcaagatcggactgatggagatccagctaaaagttggagctcaggaaccaggggctttgtccagttgatctggctttcaaaagggacaatcctatcaggctccattggccataaaagtgggcgtttccaggggctgcttaggactgggcaacagcattctgggaggggccagaggaaggcagcatagttagaaattccaactgcaggtaagaggggagatgttaagacagtggttgggagcagggaaggtatagtaccattcccataaaatagcaatgcatgaactttgtattagtccatttttgcattgctatgaagaaatacctgagactgggtaatttacaaagaaaagaagtgtaatcgactcatgactctgaaggctgtacaggaagtagtggcttcttctggggaggcctcaggaagcttctaatcatagcagaaggcaaagggggcgcaggctagtcaagtctcatggctagagcaggagcaagagagcaagagaggaggtgccgcactctttaaatgatcagatctgcaagaactcactcactatcacgaggacagtaccgggagagatggtgctaaactatccacaagaaatcagcccccatgatcaaatcacccccctccaggccccacccccaacattagggattacattttaatatgagatttgggcagagacacacatccaaactctgtcagtctgtaaccacagggattccgttcacttcctacagactctgctactttgcaaaactgtggaagaacagccaggtttgggagagtttgcaggcttccaggatctctggaatggcagacagcacttgcactctgaaaagatttcattaagagtccagagacccaagcggggatcccagctgtgctgtgacctgactgtgacctctatggcaagacccccctccagcccagaccaccctcctgcactcactatggatccctgaatatgccaatcagacgtgttggtgagaactgtttttctgtggtttccctctcccaggcagcagctgataggagcagaagccatggtcaagctagcgtgggtttgatattagcaaagtggagagagaggagccagcctgttgctattgcctgaatgctcacgttccactcctgccctttccggctaccctgctcgcccatgccctgcacaagcacacagctgccctcagcctgccacggtcctgccctgctctccatctcctcagccgtgaccttcaaggctcccctttaaccgcatgctgtctttcttcaaatatattccatgggtactttcggcccaacagctttgccctcttggtggagtccagtggtacatactgcaagcagcagaaatttccacctgcataaagagttctctcccactcccctctcctcagtgtgccatgcaagactgcagcaccaagaaagcatttgctacctgatgaagagaagtggtcacctactgattccaggccctggcgtggagccaggcctgcccagcctagaaaaaactacgcctctctccccatggggggtggcagctcccatccccatcccagtgaggatctcttaggagaagcaatttttaaacgttgtgcaacactcagaattcattgaaactcataggcaggagttctgggtagactcttgcttagaggagtgatgcaatctgaaagcatctgtgagatagacccttggaaggagctggggtctccgcacaccggtggcaccttcaaggttgtaaagggaggcacagggcctatgcagttcttcagaatgaaagagagaaatggagagagaggggcaaatagagtcagaagatagactgactgacttcattgtactttagaattgcagtaaaatagcataggacctagaagtaaagtagggattagggactggttctgctactcattggcagtgtgaccttgacagaagttgctcacctctcccctctaatttataaaatgggaataacaatcctctctcaagtgctgctgggagggttaatttagagaaggtaaatgaaggtgctaggcagaatggaaagtcctgcacactgagaagctagtccaggagcagctggacatcagcatggtggatggggacttagggcatcaggcttaacctcgagcccagtgcactgtcttgctcagctctgcagccagacaaaggggctaagagagaagatgagaggagagatcaggaggctgagggcctgggagggggagcccctagatatcagtgtcagggcagagccaatggtccaggattcatggcttccgttatccctgcagaggatagacactgaggaccagcttgatgctgttcctgctgcaccaaagggtaagcggagttgggctaaatggcatttggaataagcacccaggagaggcctgaagactgtgcaggcagcgaggttcaaagcacaaggttcccaggctttgagcatcctacttctccagtgtccctcgcatccatttgtcccagacctcctaccccagtctgccctagttgaggccccatcatatttcccatgaacctgatatggtttgcacgtgtgttccctccacatctcatgttgaaatgttattcctcgtgttggaggcggggcttcgtgggaggtgtttggattttgggggcgagaccctcatggatggcttagtaccatccccttggtgatgagtgagtgctttctctgagttcacgcaagagggttgtttaaagagcgtgtcccctcccgcgccccttgctcctgctctcatcatgtgaggcactggctccccctttgccttctgctgtgattggaagctttctgaggccctcctgagaagcagatgctggcacaatgcttcctgtacaacatgcacagtggtgagccaatttaacctcttttctttataaattacccaatctcagatattcctttatagcaaacaaaaatggcctaatgcaggagcattacgacagcaccatcactgtcccccagcctgcagtctccactactccactcatttccaacagctttcagctgggccatgttaaggcgcatctcagtgtgtctttacctggcttgtaaaccttcaaattggtgtcctcacagatactgcctagagcagtttcccaaatgatcttccgagtcacactagttcctataaaatattaatggtgttccttggaaaaaaagctccatgcccaaattgtgttggaactgctgggcacagcaacaaaggcaagcttccacacagatggacttctcagcacccctaccatgcaggctgtaccgtgaaactcccagaaggggagaatgggccaccatttccttgttccctagcttactgggaacatcttcttcctcgctcttttgtggaagtagaattccactgaacacagtgtggggaaatgtggcctaaagaacgaagtccaaattccttatgctagcattcaggataacctgtgattaggtcctaggatcatggagaattgagttaattgtatcagaatgggatttccacaacgacaaaagcctccagtgagagtaaatgaactcgaagcagaagagatcttgtgctgcaatcctggggatggtgccataggtgggaataggtggatgcatgagggtcaggtagcctggagactctgggcttaaagaaggatctacttagaaaggaagtttctggttgaacactttaaagggagactattgtgaatgtagcactaatatctgccctacccatctgagaaatggctgtgataaggtagaggacataggagtgggaacaagatttggaagtcacgtagtttggtggtctcataatagtgttcctagcagtcacctggaggtacttgttagacacgcaccccccacactcccctcaacatgcacatggaaattctaacacagcagatctgaaatggaacttgggaatctaaatttaaaatatgtttcccagatgacttgaatgcatgtggtctttacatatttccatatatattgatccaatcaatattggctaatagatattgatctattctttgtttcataaagacaatgaagctgaggcccgttcaatccatggggggccaggccatgagttgaggtgccttctaactttacagcaggtctctctccactttaccaggtctgagtgagctggaagtcatccctgggagaatcagggtttggagagacaaggagcaagttgtgtcctctctggaggactaatctggaagtttaattacataaacataggaagaaaatactgaagagcctaagggggtgacagccatagtgattttaaccagctggttagagtacagtgaagtattcagggtgagagaattatgctaggccaagggataaaaccttgcatggagaaaggatggtgatgacatgcttccagggaggccagccatgctccagaatgtcctcgcctagaatagtcgaagagtcagtcaatatagctacaagtatttttcgagcattagtgctttaggtcaggagcggagtctgggacagggactcagagacagaatgcactgagggatcaagggactgggagaagtaggacatggtgggaggaaagaggcaaggatgtagcctccgctgaagtctagcttcttctggacccatggggaactcaggaacatggcatctgttttaaagagctatcttgcatcgtgccctgaaattcagcagttgttggctctgctgagctggtcccacctcgaggcaagggttggactgctgtactctcatatcagtctgttaatggctgcaggctgctcctcctggggagtggggtgggagctaccctttcagaggaggtggcttccttcagctgagaacagttatccagagaaggtacagctgtgatttgccagctgctaatacttggagaaggtgggagctggaggcatggcagagtagaggggatttggtggagtgcacacagcatccatcaccacccaattgttttgtaccctacggaggggaaaactgaggtcttgagagaacaaaggacttgctgagggtcacatggctcagttcctgagtttggagctctactgtcaccaagtcccttatttttatccacagatcctcgaagcaaaagggtgtcactggtggaatctgtttctttgtcctttctaggtagagccaacaacccctgagcttcagggcatgctgcaagatttttctttaaaaccggtgctatattgatttttgcaggatcttgtccttgctgcctctgtcctatacactgtaatgaattgctttctttttctgcttgtacctgggggtgactttatcatagacagggctattttaaaaagcagacggcaatgtcctcttcaatatgtttccctgatggataaaagtgcatactcaaatgaacacaatgttggaatcatagaatttagcactggaaagggaatatcagagactatctagggatcagcggggtggaggggggatgttttcagcatccatgatatgccaccacccactcttcttcacacaccttttccttggcaggttttgactacaagtctgcaggtgtgcagtggctgatttctctccctccccactttatgaaccagacacatagcagcagagtaggcaataaaaaaaatcccaggatttcctgtgttatcacttatagcctatcagagcttctgatcactgcaagataatctgagacaatacctgagccaatatcattccatccaaagcaaagaagcttgacattttaattaacttgtctggcctggtcatgggcatatgtagaattctcggggggtgttttgaaatatcaaaacagctcttggatttcagttttgaccttcaaattcctctgggggtctgggaaagcccacttgggactctgagtattttcagactgcagatggggaagctgaagcccagagtggggaagtgattttcccaaggccacatagcaaagaagataaaaaactgaaacttaaggtcagatatttcctcgagacatcagaagttaaagcccatgatataatgagtgaaaacatgcatagtaaactgtaaagctgtctacatatgtatgtgataggccttgagtccactccttgagtccatcattttgaaagtttgcctcgacaagcagcaggactgagaagttatcagaaacctggaaataccaagacttacaggttgttttttgtttttcagttttttttgagacggagttttgctccgtcaccaggctggagtgcagtggtgcgatctttgctcactgcaacctctgcctcccaggttcaagcgattctcctgccacagcctcccgagtagctgggactacaggaacacaccaccacacccagctaatttttgtatttttagtagggatggggtttcaccatgttggccaggatggtctcgatctcttgacctcgtgatctgcccgcctcagcctcctaaagtgctgggattacaggcacgagccattgtgcccggccaggacttacagttttaataaggagagccaagacatttttctgtggcttttcttgaaggtgatctcactgcactgactgacgatccttccccatttttatagcaatctggtggtgatatcacagcaaataaatttaagtgacatgttcacttcagtcgcaggctttaaactctaactaagcactgtattttattttcccgaagatgtggcacacagctgattcacctgtactcctgagtcatatttataggacaaaagctttcttggcagcaacgcgaatcagttcatgatcttcaagattcattgcaaaagctgggtgcatgtggctttctgtctggaagggctgaagtcatattattctccctcattgacacagggttcactgccatgtgggctcaggctgcccacctgaggtgctgttctcattaaggagatttgcctccacaagctctaagactgcttggaagatgtggggtcatttgaaaggtattactgaattgcttcctttggccctctcctgcagatcctgaaattccattagagtgtctcagttcagtttcattcattgacatccaagctggaagggacctgggaaaatacctaaattagcatcgtcattgcacaaatgagaaacagaggcttctaccaggggtgtgtctcacctgtggtcacacagctaatgacagagccagaactaggacttagaactgttggctcctcctggagggctgattttgccacatcctgttgtcttctcaattgaacaacacctgatagagtgcttatcaggctctggtgtggacaacgtagccacacattcattctttcagcacactttatcaaattcctatcacatgtgaggcactgttctaagctgttgggagcagggtgatgaacatgataaagggttttattttatgagcttctattcttgggagagagatgaactgatcaactaataaataagtaggcaaacagataacatcaaagacttaaaagtactatttaaaaaacaaagccacatagggacttagtaggagagagagtgatggttctagggaggtactttggcgagactgtccaagaaacacatctctgtagagatggcttttgagcagagacaaaataacaaagcaagtcatctgaagatctccccaggcagggtgaagagtggaggtaaaggccctgaggtcagaattagcttgatgtactcaaagaatagaaagaagatccatgtgactctagtagaaggaataaggtgagagtcttagaacacgagtttacagaaataggcatgggctagatctcctaaaatagaatctttttaaaaattagcttgtaataattgtacttatttattaagcacaagtgatattttgatacatatacaatgtatcacgatcaaatcagggtaattggcatgtacattgcctcaagcatttatcatctctttgtgttggaaacactctgaatcctctcttccagctattttgaagtacgcaatacatttttgacaaaggtgtgaagtacatgtatttgggaaagaagagtctcttcaataaatgatgctgggaagattggatatccatgtgcagaagaataaaatcagatcatctctgcctatctctaacatagaatcttgtggctcatgacaaagcatttagattttatttgtaattgattaagatgatctgattaacagtttttaaaagtcactctaattgttgccaggagattttcatataaggggtttggtaaggaggttttgcagcagtccaggtgaccatggaggcagtagtgaacttggaaaaatgatgtgtgctcagattctgagtgtatcttgagtgcagagctaacattcttgctaatggattggatgagggtatgaaggaaagaaaggagataaagttgcattctttaattgaataaatggaatgccacttattgaggcgaataaatacgtggaagaaatgtttatgtgattaggggaggtggatgaaaacatgagttctgatttggatgtgttaagtttgaaatacttagtcaacaatcaagtggagacaaaagtaggcaattgatacatgggtctggagttcagaaaagacattaggcttaaaaaacaaagtttttaaaaattttttatagtttggggcttagcaaactacagcctgcagatcaaatccatctgctggctgtttcttgtaaataaagttttattggaacacaacaacattcatcctcatattgtctgtagctgcttttgcattacaacagcaggagttgaaagaccatctgagtcaaaaaacctacaatatttcctagtctggcctttatggaaagttcactggacactgtaatagttaatatttaaaactgtgaaagtagataatagtaagaaataagtgggagtatagacaagaaaaaatgacaaataactgagtcctggggcatttcaccatttagaggactagaagagagtggggaccatcaaaggagattgaatggagtgactggcaagataggagaaaaggatagtgtggtgtccgttatgtcagatggtgttgataagcagagataaatgaggtctaagattcagcctttgggcttggcaagatagcaggcatctgtgaccctaaaagggtctattgtattgtaggggtgggaatagcagctcaactcaaatagcattagggaaaaaaaaaagggtgaagaaatagagacagtgggagcagatatatctcgagtaattttgctgtaaatgggagcatagaaatgggggtgtggctagaaagggatgtgggggtctagagaattgttcttaatttgggagacattttggcatagttgagaattggtgggaatggagggagaaattggtgacacaggagagacaaagaatgttggaagaaacaaagttcttggctagaaagcagtgttcagaacccacacttgggctggataggacggccttagatgggatcagtgctatggtttcaacatttgtgtctacttcaaaattcatgttgaaacttaatccccagtgcaatggtattaaaaagtgaggccttttagaaggtgattaagtcatgatggctcttccctcaatggtgagattaggaccttataaaagggcttgagggaataagttttccttttccttccttctaccatgtgaagacacagcattcaacccctctggaggaagtagcatttaaggcaccatcttggaagcagggaccagagcctctccagatactaaacctactggcaccttgatcttggacttcgcagactccagaaccgtaagcatagatttctgttctttataaattacccagtctcagcaggaatggactaagacaaccaggaataattcttccattgtaacagaatgaaagcagataggttggttgatttgaggtgggaagattaagaaggtttttttttcttgttgcttctatactgttttcttagggaaatagtaggtaaaacccacttctacgtatatacccaagagacattaaaacatacatccaatcaaaaacctgtacgtgaatgttcatagcagatgtattcataagagtcaaaaagtgggaaaaacccaaatgtctatgaactgatgaatgactaaataacatgtggtatatccatacatgggtatattactagacactaaaaagaataaagtgtggatacattccataacatagatgaaccttaaaaacattatgctaagtgaaagaaaccagtcaacacaaaagaccacgtaagattccacttatgaaatatctggaacaggcaaatctataaggacagaaaatagattagtggttgcctaaagttggaatggaggttggggaaaatcatgagcgctaatgggtatgaagttttcttttgagtgatgaaaatgttttaaaactgatgtggtgatgattgtacagcagctctagcaaactgacacaggtgacaaggataaagacattcatctggctggaggggaaataagttcttccttaagtctttcaaaaatttggacccatggggggtgactagaagggatatgacctaagagctcaagggatttgaaaacattgtgcttgctcacctacacccatctaatcttcgacaaagctaacaaaaacaagcaatgaggaaaggactctattcaagaaatgctgctaggataacttgctagccatatgcagattgaaattggatccctaccattcaccatatacaaaaaccaactcaagatgaattaaagacttaaatgtaaaatctgaaactataaagaaccctagaagaaaatctgtgaccctcagcaagtgcaattattattttttctttccaacttttattttagtttcaagggggtacttgctgagggtcacagggtccagaagagtctttgaaatggaggtggaagttttcacaggtgtatgtgtgtgtgtttctgtgtgtgtgtgtgcgtgtgtgtgtgtgtgtgcatgtcatgtgcacatttgtgggccaaagtattatagaaacaaagtcgtggagacaggagagcatgaagtgggtttgggagcagcacagggatgaatgataggattaggccagggaggcaagctggggctttgtttcagatactgctccagtgggtggccccatttttcagggctagatgaagataacgaaagtgggagccactgtttccccacaagtttcctagaggagaggatgggccaatcagtggttgtcctggaagccacaatgagcctagagcccatgtgtgagatatagacaaggaaaagtcacttggggcagttgggaatatcaacgaggaaggaaccttccaccctaaaggtgtggtaaacttaggagaggttgggtccacgcaaagagggtctactttgggagtgggtacattagggaggcacagaagggaagagataaactaatgaaattagtatctgctgagcagcttctgtgtcccaaacactctactaggcctttcaggtgtgttatctgagctccttctcacaatagcccagtaaaaatggtaccattaccccatcttccacataagaaataggctcagagagaggtagtcacacgcccaaaggcaaacagctagtggccaggctgagcatgaatctaaatttccctgtttcatttttacactctaccatacctctgcaataatttttgaaaggacagattgcctggccagatgggacatctgctcagttcttgttgaccacattccacccacccctctggcataaacatgccttgttcacccaagcagaggagcttggataccatctacgcctccttgggttcttaaagaccacaagaatagtcacccaagatgaaatggtgatgcttttgcctaaagcgggggcctcagtgggctcagagaccgatgggaatgtgtgtgacagtgtgtttatcatattcaaagggagacctttctgataacaactgttgtactggggacagttattttcaaccagggctctttcaagaaaatatggtcaataaacttcatgtgcccttcagctaaaagcattttactttaaccttcagctatagaaagcctggggaatatgacaacggttttcgttcattgaccacctactgtgtaccaggggctctacatatattatctttcgttgtgatgggaaacacagggatggtgcattgccagccactgaagccaacgtagcagaagcatgagagcccttgtcacataggtgagcaccagggcagtaatccccaaagtctgctgggtggaaagaatgggtggtcctctatctggtgcgctccctgcagccacacagattgcatttctgggacacttgctatggtttaaatacgatccccaaattttatgtattcgatatttaatccccaaatttatatgttgatggcatttggaggtggaaactttgggaggtaattaccattagataaggtcatcagggtggggtccccaagatggaactggtagctttataagaagaggaagagggacctgagctggcatgctcttgctgtcttaccatgtgatgccctttgtgatgttatgacatgataagaaagccctcaccagatgcagcccctcaaccttggacttcccagcctccagaactataagaagtattttttttcttcataaattacccgtccttgcgtattcagccatagcaacagaaaaaagacaaagacaatactgtgatctgcattcctggagaggggcagaacatctgagcttcccacgtcatcacagcctctgccaagcctctctgatagtttctgcttttctggcaatttcaagccatctccccatgggctcagtggttgcctttctccattctgagaagattctgattgtgaattcagcacaaaatcaaagccggttctccttgatttttctccttcctttactagggaattttctgtttcattagagcaattgatactcttctaccagcaagattttgtgtgcacagtgattccactgggacaagtgtccaaatagaccttattttctgagcttgtgattcactgggggtagattcaaggaaattgatgagcgcatcaccacatgtatgagggtccgtgactcttgaaatagctcatgtcctgctagtctagattgcagccttattaactcttccttggacacaacctctaatggcttccccactttcactgcctgtcactcacctggaaatgctcagtgaggctggggcacgcagaacagaaaaggccattgcagaattacggagtaaacataaaagacgccagggaaaggggagggtaagtctaggactaagaaggcttgtggggtgggggagctggaaggtggcagaggagctgattttctgagaatcttctacataccagacactactctgagccttttaagctcaatatcacagtgtaatccttctaaagcataattctgctctcaccgcttctctgtttaaaacccttcgaaggcatgttgacacctgtaaaatagagatccaaaccacttcttatgatatagaagactccccagctccagttcctgcctactttgcaccacttttctttcgtacaccctgtagtcatacaatggcttcacctacaactgacacttgccatttcccaatgacttcctctcatgccttcaagcctcagcatgtgctgatctctttggtctgataccctgtcttcagtgtcttcatctgttaggtaaacaacctgcatttgttctttaaatgtctcttactctaggccgggcaagtggttcatgcctgtaatcccagcactttgggaagctgaagtgggtgaatcacctgaggtcaggagtttgagaccagcctggccaacatggtaaaaccccatctctactaaaaatacaaaaattagccagatgtaatggcgcatgcctctaatcccagctactggggaatctgaggctggagagctctttgaacccgggaggcagaggttgcagtgggccgagatcatgacattgcactccagcctgggtgacagagtgagactctgtcaaataaataaataaataaatgcgtcttcctttggacacagccttttgtcttccccaggcttggacagctgtcctctaactgggttcgcatatgccccattgcaagccctatcctagacacatttcaccacatagtagttatctgttgccccaccggacagtgagctccttcaggaccaggtctggatccctgaaccctcagcagcctgcatgatactgagcatgtggttggccctccaaatacgtctgttgtgtgaatcaatgtctgagtccatttgcagataggctggcaggataccaaatttctttcaaaagcagtgtcagaaagcttctagtagccagttactttttgatacccagggatgcaactgtagaactttgggtcctttaaaaccagtaaagtcatcagaaaactttagtgggtgaagacatggagggacacacatttccagcaagtgcaggagaggaaacaaagaaaatcaccagaagatctgacttctgagctgttcatgcctgggcaattcagaaggcagcaaaatgctctgggcaaagccagagtttatttattctggcattcaagccagtattcaagccaaattcaagccagtattaataatataatggctttaaaatggtttggtattcctggcatggccttcctcacctgtgcaagcccagaataccccgccccctagcatatagacattcattcacccactcattcatttttttcatttactcattgaacacatagtctattaagtgccagctctgtgccaggctttatactactgcccggtaagtaagagattgtcagagaaaatgaacctactgagggatgggaaaagtacatggtctctctaatacaatgagtggtatagtggacttagcacagaggagggcccctgatctagccagggattcaaggaagactcaaacttgacaaatgaggaaagaagcctttactagcagatggaatagtggggccaagtcctgggggtgtgagaaagaactgtgtattgttaggactccaggttgttcatcactgatgaataatgatgccagagaggaggcagggctgaatctagggggccatgaatgacaagtcaatagttgtcattttaacctttggatgatgtgagccactggaaagctttaagcgaggaaggacaggatctgatttgcagtgattgccaggctgctatttggaggataaaatgaggttggaagtccaaggtgaggggtggagactgactgtaatcagtgaaggagcttgcttcaattctggtgcagatgcatttgaggactacttcctctgctgcctgactcaatgcaacattcagatcttcctctcatggagagttcataggttcagaggcatcaaattcttttgttaggtgacttgtgccttttatgtagtctgaggagatgtgctgaagactgatttcatgcccacttgtcaccagcctgatgtctgttacaccctcaaaattctatggcttcacagaagtgaagcttggggggccttggagaccatataaccaaagctctgtgctgactatacctgcctttgtctctttcattccagcttatttgggagtgacttgaaaagtaccatgagtataacccttccctgaagtgtagggaccagcccctcccttcctctcctgcttcctatccctcagcatttttttaatgggagaatgtcttaatttttcctttattcttgagggatagttttgctagatataaaattattggttaagagggtttttttgtttgtttgtttggtttttttttttcaggactttaaatatgtcatcccactgccttctggcctctttggtttctgatgagaaatcagctgttatcatattgaggtttctttgtacacaatgagttggttctctcttgttgctttcaaaattccctttgtgactttgggtttccacaatttgaatataatatgtcttgatgtgaatcttagaagttatcttgttcagaattaattgaactttatgagtgtgtagattcatatctatcatcaggtttggaactattttgtttttgagatgaggggtctcatctcaaaaaaaaagtgagattggggcttttttttctttttgagtctcactctgtcacccagactggagtgcagtggcacaatcatagctcactgcaaccttgaactcctgggttcaagcaatcctcctgcctcagtctcctgagtagctgggactataggcatatgccaccacactcagctcatttaaaaaaaaatttagtagagatgaggtcttggtatgttgagcaggctggaggtttgggaagcttttagccactattttctctccattctccttctgggattcctatgatgcatatattggtacaattggtggtgttccacaggttcctcaggctctgttcgtttgtcttcattttgttttctttctattccccagactggatcatatcaatggccttatcttcaagttatctgatcctttattcttcttgcttaaatctactattgaagtcctccagtgaattttttatttcaactattgtacttttcaaccagaatttctgtttggttcctttttataatgtctatctctttattaatattttcattttgtccatacattcctttcctaatttcatttagtgctttgttcatggttttcttcagctcatggaacacatttaatacagctgatttaacatctttgcctagttatgtctggtcttcctcagagatggtttctgttaagtttttttttttcctatgattggatcatactcttctgtttctttgtaggttttgttttttttttccttgagaactggacattctgagtattataatgtggcaactctggaaatcagattcttcccctcttctaagattgctgatttttgcttcttgaaggctagcattatctgtttgtgacttttccaacttatttctgcaaagtacatattccttgttgtgtctggtcactgaactttatgttctattttctttgcagtcaactagtgacctaacaaagatttttctaaatgatggggtaaagggttctgtctctttaaatcttcgaatagatgacaccagggaagtcactgatgacaagagactgtaccagtctctcaagccatgaccaaagcaaccaaaatgtacaacttcaaacttttggaggaaaagtctcactgcccaccctctcacagccagctgtgccaagaatataagcttctatgcccacaggtgtagtggggctgagaaatggaggaaagtactcggtttgcccatgctactcacttatgaaggatcagcagcctcttcctttatcaagaattctattgggtgtcattaatgtcctcaagttccagagttccagaagagtttatttcacttactcttttcagctttatgtttgctttgggggagggactggtctatagagctatttgcaccatgattttgggtgatttcagggtatcacttggaagagctttctgagttcccctatctgggagggaggcatctggggcttggtagaatgtcagtggtaagttcaggtctcaaagaatagaagcagggatttgaccacttaggattggctccaggcttggattcagagtgagagggaggggtgaattggggccctctttaatgctactcagctcaccacctttgggtaggatgaagtagcaactgacatctactgagtgcctgacattttttcattaaagcttcaccagtcttgaatacgaaattttactgtcctcatttcataaatgaaatgacagaggctcagagaggtgatataatatttcccataccatatagctggtaatggtgggggcaggatttgaacctaggtctgtgcaagtccacagcttaacccctctcagcctatcatgctttggatggggagtccatgtagtagccctgcctagaaataaaaatgtagtatttgattagaccttcacctgggctgtacctctcagaggctaagtcaactggacctcagtttttccatctctacagtgggagctcaaggtggtttatctctgagattctatggaattcaaagaaagcagggacccaaaacaggcctgtaaagcccaagttaagagcttcccaggactcagagagaggggctgggtccagcctggctgcgacagggcatattccctccacagaggaccagtccttctcagcagcaccaggctggccctttgtctgctgaggtgccagttggctgaagaagctgctaatctctgcttagcatcctggcaggatagggggctagagagccagggttggaaggagctgcatcttccttcaaggaggccttcattacacccacaccttgggcactgcaaggtgatctctctgtcttgttccaaacatggccaaagactggccttggctgaacatggcttatcttcagagaacactctatgctcagctgaaattagaaccattgtttactttgacactgtcaacccctcaactttttgcttcctacctgcatgttggctgctagcctatgcttgctgacatagcagatcctactcttcagaccagggccatttgctgtggggagttagcctttccatggagttgcatttcctgcctctcacccaggtaaaatccctcctagtggccttgccccacgggaaaaaagcaagagtggtccttcctcatcataactaacaccaggcaccagttggatgctcgaggcaggtaaactccatcctgatccacactcaacacttccctgccttcattcaggttgttcttcctcctctttcatgttatccaatcaaagagcagggagctacattttctccttctcttggcttctctgcaaactgagttgaaaccagcagatacacaagggtccttgctgtgtgtcaggcatcaaagcaccaagatgaaagaggtggtccctggcctcaggaactcataataaatgtcaaccgattggctgaggccagaagagctccgaagacccaaaatcagagaggttatggaaaggtcctccatttttcaaaccaatgagggatggaactttcccttattggaaatgaaccaggaatgatccagggataaggcatgcagcctagaagctgctgtctgtggtgtcagagaaacagaactaatagtttcgcgctctctctctctgtgtgtgtgtgtgtgtgtgcagaaagagagagagagagagagagatttattacttgtatagcaattgactaacatgattacagaggctgacaagtcccaagatctgcactctgcaagctggagacctgggagggccgatgagtagttccagtcctaaagcaggcaaactcaagaccccgaaagggctgatgtttcagttcaagtcagaagcaggaaaaacctgacatcccagcttaaaggcgggaaggcaaaagaagctccttctgactcagtctttttgttccattcaggagggcaatctgctttactcagtttaccaactcaaatgttaatctcatccagaaacaccctcacagacacacccagtgtaatgtttgaccaaatgtctgggtgccctgtggcccagccaagttgacacataaaattcgccatcacagggagaatcttccactggtttctgtgtgctgagtctcaccatccgacagagtgatgcatcatttgatggggagaatgtagcagagacattaatggtgcggactctgagccactctcagcatttgtgccctagatttatcactttctctctgtgtgaagttggtcactttgtttaaccttctgtgtctaagttatcccaccagcaagatgcagctattaatagaaaccatgttgtggtgttgtaacagaagagagtaactctgcaaagcacttagcacagtgtctcgtggataatacctgctcaagacttgtgagttattgtcattgttgttattacagactttttgcctcttcctccagagtgtgtgctaactcagcacagagaaaagtacatggggtttggacccagaaaggccaagtctgactccatcccgcacatctagagcaaatagccaaggttctctgtgcctggcactccctgtgtgtaagtagggaggatgtgacttcaatagattgcttcaagggttagagaaagcgtccatagagcatccagcccacctgagctactcaacagtagctggtttccacccccaatggcagagactgcatctgtctttcattggcatccccagtgagcaccatactcatagtaagggctcataagaggttgtttgaatgcagtggctttgccttatgagaaaacatggccctatctattcccagacaccctttctagagatcaggtccaacaggtgctcagtatcatgttttctccacacagtcttctaagaggacattgtgtcccaggtacttgtgaaactcatgctgctgccaggtctaagcgagctaatggaaggcaaaagagatggctggtgggagaagagcaaggctgtttcccaactctgggacaacgggaagtgaatagaaaatagagaatcaattgcacttgggagtgattcagaataaattgccactgtgtcccctgagccatcaccccactgaccaatggtcttccttatgtcaatttagtgttttccatttgtaaagtacccggacatcaccacatccctgaagacaggccgggcaggggcaattattctcatttttcagaagaggaaactgaagctgagtagaggaatttgcccggggtcacacagctctcctctttctcaggttcgtgtttttctccatggagacaaactagagtcttttcagagtatccttggtggctggccaggcagaaagcacagccccacaggtatgtctcaggctggcaaacatccctgagtggctggagatgaaggatttcttcaacagtaaattgagtctatgttattgtaacaagagttgtgcttctgactccaaaggcagcccaaatggtcaatcaggacataggtctttctctccagcccttgtcagtgggtgccaaagtctctttcttctcttcttcttctcatccttcccctgctccttgtccttcttctttatctgctccttcttttccttctttttccataatcgcttttcttgaccagattgcaacatgcagcttcacactttaatggtctggccttgggataaagtcatcaatattccaagaaaccatttcagggatttttttctttcttagtctctttttaagtcaggtgtttttaacctgatgccatggacagtgattgactctgaaaaacagggaatatttgaattgatgttaaatttttgtgtcttttttatgtgaattggggatggaggacatagcattcatcaaattctcaaaatggcataaacatagaaagggtctttattaagggcctattgactcagacttaacacacaatgatgacaaaatggtatgatgtgggcttcctgatccatggaaaaatggcagaatctaagcaagaagacccctgcacacagcagggcctaagccaagttgtctgatgtctgtggacatgacagatgaaaagaattggtgtttgtcttttgaaattatttggtccaagctgagtgactctctttatagagaagtgatcaaagaagagtctatcagcctgcaatcccagcatttggggaggccaaggcatgtggatcattgaggtcaggagtttgagactggcctgaccaatatggcgaaaccccgtctccactaaaaatacaaaaattagcctggtgtaatggcacacgcgtgtaattccagctacttgggaggctgagacaaaagaataccttacaccagggaggtggaggttgcagtgagctgagattgtgccactgcactgcagcctgggtgacagagtgagactgcctcaaaaacaaaacaaaacaaaacagtctatcattgcactgaattgttttacagagaagaggtgacaaattttattcttgcagaaatatcacatatctggagtagaaacatggaagaagtttattttccttttctagagagcttcccatcaaaagaaatggaaaaaaatgaagctttgggaatttagttggacaaaagaaagaacttcttggattcaatgcaattacagtgtaatttggccaagaatctatctttggattgagctgatggctaggaaacttagaagttattagtcaccctggagttcagtacacaggctgatgcctattggaatccttttcccatcatcatatcccagtcctgtccacacaaagaatcatgataagtacgatcattaggtgataccaacatatggggctgttgggtttaattacgagaaatcccatgttctagtggaaagagatcaggctttgaagtcataaagtcttgggttcacttcttggctgcactgctcatcagctgcatgatttgaggcaactttcttcattctgtaattttctcattccttgagcataaagtgaggatgaagactcttgccttaccatttggttatgatgattaaatgagataatgtacaataaagagctcagcctgggacccgatgtgttaattccctttttcccactgaaaacgtgtttatctaaaggtccagctccagggaacccaggctgctcagaacaggaatctccaagcaagaagggagagtccaagaataaacaaaaaagttgtgacaaaactcaagcactgagccctactcagccctactggtttccattttacccatatgcccagctacttcatgatttagttttctagcttctagttgattagaaattgaattagaattgggttaatattcagctctctttcatctttggaaaaaaaaagaattgggttcataaaaggagaaactattatattcatacataagattaccaagaaaagattttgaaaaaatataaaaaagtaaaccctagatatgaccagcaagggcagtatgttagcccaggactgctgtaacaaagtgctatacaacgagtggtttaaccaacagaaatttattctcacagtcctggaggctacaagttggaaattatgggataggcaggattggttccttctgagggctgtgagggagaatcagttcatgcccctctcccacttttagggtgatttgctgtcagtctttcaagccatagtaggtgtttcttggcttatggatgcatcaccctgatttctgccttcatctccacctggcattctccctgtgtttgtgtgtctgtctccaagcttcccctttttataaggacaccagtcatattggattagggtctctctctactccagtatgacttaatattaactcattatatctgcaaagaccctattcccaaataaggtcacattctgagatactgaaggttaggacttcaacatacgaataggtagggtgatgcaatttaatctatactaggtagaaatctgggattatttagtttaggggcaagcaatatctactttctgaaagaaagactatattttgccccatactcagaatgatgatccctgggtcattaagaagacacttaaattttgttcagcatcttatcattttagaaagatctctgtaaaaaatgactaatgtggaagacgcatggggctcgatgctcactgatgcaaactcactgctcaccaggcacaaatgcagggtacaagctgcctttccagaggattcccaaagcaggcagctgagcacccacaacagcatgagatcagttttgtggttttcacctcaagctttaggaccacagggtctctgctgagctgacttgcaggaacttggactagaagcagaatgacttcttctgctaggtacaggtcacctgaactaaccagggatgtggaccaggctctgagcagatgctcaaaggaggattccatgagatcactggctttcaggaatcactcctccctagggagtgtgttaacatctctggctatgaaatatatatactatgcagcaaggcataaaacaaatggcacctactgtctgcacctccagactgagtatttatatacgcatcggaggcagtctgaagtagcctaaagagaatcagaaaacctaggtctgaggcccagctcactaacttcctagcagagcaagtttggcgagtgccttaccctctctaaacatcagtttctaaatctgcaaaatagtgatgacttccacacagggtgatgtaaatatcgcacggggcaatgggtgagaaagtacctggaacgctttagggtgtgccataggtgcactgagtcatgctggtctccacccaactcctctcgggggctgtgttctcatttcccagatgcggtaggtgttggctgccagcagctcatgcttgcatccttttggagggtggcctttggttgatgggagctactttgcccagagatgcctgggatgtatagccaaacccccaggagtgacctgtggccagtggcagattgatatggggtgtaaccacccagccctcctgcctctgccaagacaacttctgtggtttatctgaagctccagagctccccatggcgtcaggaggccagactcccactaaaccacacatttgcctagcttgtccccttcccatgtttcacatttctgactccttcacaggtttctcctgagaacacttcctctttaaattgctcacacaagaatctctatcttaggctccatttctagggaacctgacctaagccaggaggccatgcaagaatcactggttggtctttccatcttgcagtgtttcctctttcagaggtgacactaactaatctgactctaagatctttgcacagttctttactctgtcctgaatgttcttcccccagatcatcagccggctgactccttgtcagtcagatctctgtttaaatgtcaccagcatagagaagccctccctaactgtgcgatgtaaatggccatttacattccccatgtagcccttggcatactctgcttcttgcgatctctttgtttattatctcatccctcttccttcccctgtggtaagcgagtctcgcttttcgtctctgcgatagcacatttgggctgaacagtctctgagggtccttcctgctttggcattccactttctatgggctgggatcaaacgcaaagcattaacattccattagcaacagcaggcaagtgatagcgtgagagttccacggctgcctcctgcgtgacccagtgcagactccttccctccctgagtcggtttcctcacctgctgcacagaggtaggataagatgacctccagctgcagtcctataattctgatgacatgtaatgtctattgtttctggaacctggggacacactactgcaggactgcttgtgttgaaccttctttgttttctgtgctttcttaaaacagttatagtcagctgatgtgaagacttgcaaatgcttttttattattttggggagtatgcctggcttcatcttaataccattaggcctgtgtccctcaaacctcatcctttccaatcacagatgctgaaaagaaacctgtttctccctgtcatccataggtgcatgggaaaatgagacatagtccctacaccaaggtgctcagtctctcaagtgactgtaattatagcacattgcattcattcattctttcctgcattaattcgtacatttattcaacaaatacctagtgaatgactattatctaggctctgaggactcaacagtgaacaagataaactgcctatgctcatggagcttgcgttcttgtgttacctgccatcaaaaagtatttcagggtccttcctctcaagcactgaagagaaggcaaccacctctctctgcttggatagacttggaagcctctttggaggagagaacatttgggctgggttttgaagaataaagaagttttccagacaaagaaggggttcatgaaggcattgctgtggctgagctggaaggacagtagcagggagactaggggaggaggccagagaggtggaccaggcagagctggattgtgaatcatcccagatagttgcactttatcctgaagataatgaggagtcactaaaggttcttgcgaatgggaaagatatggtttgagaagtgtcttgacactcaggcagcgtggcggagagtattcatttcctgcaacagctgtaaccaatcaccacagactgggtgacttaagacaacagaagtttattttctcacaatcctggaagctggaagtctgaaatcaaggtgtccggcagggttggctccctctggaaggatcggaaggagagtcggctccatgtgtctctctcagttcctggcagttactggcaaagcttggcattccttggcttgcagttgtagcactcctatctctgcttcacgtggtcctctccagcgtgtctctgccctcacacggccttccactctctctgtttcttctcttcttatatggacactggtcatattgaatgaagggcccgccccattccaacatgacctcatcttaactaattacatcagcaatgaccctattcccaaataaagtctcactctgaggtactggggttagcacttcaacacatcttttatgagcacgcggtcagcaggaatggggccacagagccaggggggccagcatgaggtggacactctgcctgtaacagcacctgtgtcaccaggtgagggacttgtggggagatctgggtttggggtatttccatagccctctatgtgggattgaaaaccatcagttgtccataacaaagaatggggcaaataattgataaggctatgggagactaaatcccatcctccagtcactcctgaagcagtcactgccttctctgtggatggttcctcctctctgataatgcacgtcaccactgggagcaacttgaagagcctctctgtacttttacattctaaattatgtacatgacccatgcctgggacagccatggccagtacccagccacttagcacccagaggtgccgcaactccagcccacacctctaagcagggcccccagcagaagttgtgcagactgcaaccctgtgtgcagcttgaagacctggggtttcttctggagccctctctctgctgtggtggatgtggaatctctgccctccccacactcctaagcctccagtgatatctcctgaggtgtgggctgggcaacagagcctgtttggaatgttgttaggattttttactgctagtatcagaggagctattgtagattcttctcgtatttcacctgacccaaattgggggtggggaagtggggaacttccccttctctgaattcccacagctcttgattctcatgttgattcttgtattcattcattcatgcactcattcatttgataccttcagcaaatatttaatgagcacctattcagtgccaggctataaacaaaatagagcaaaagccctgtctcacagagctaatatttgacaattatgcgatgagtatctttcatgtgccaggcacaaggaagacacctgctcttccttttgccaagtagcatttcagtgattaaaagcttgggctgtggaattcaagagccaggtttcaaatacacaatcagttacttataagcgaggtgagctgtggccatatgttataatatctcagagcctctgtttctctctatgaactgaggacaataatatcttcccctggacagttataagatcaagtgaaatgatacatgaaatgtgcaccatagagtcatgagtgtataaaaaatgttcaatgaacattcactgttattataattgataccattattagtaaatattacagttacaagagaatgtgggttctctctcttcacctggttgtatgtgcacatcagctcatgttcagagttgagagcttgcaacaaaaacatgggtaaaataatactaaaaacaactcaaacgagaaacagaagaaaagggacagattaaaaaacaaaacaaaacaaaacaaaaccctgagaaaccacaaaaagcacaggagggaagagagaaaaatgactgaaaggctatttctgtagctgattttcaagtagcctgccttctaccagagtagaaagagtctgggcaaagagcaaggcaggctctgatgtttgtaaaggaagcacaggctgttaagtgggtaataaatgcttctgactttgacatcagagtgggatgcaccccacaggtctttttacaagagacatataggatgatgctcttcaaaacatttgcaccaaaaaactgcagggctgctcttgttggaagtctgagggaacctatttaatcgcccctctcccctctgagtgtgtaaccgattgagaatgtacacaaggagccaggcgaggctcagtatcagtgttgttattgatgatgctgtattgacaagcttccccaaactgcactcaccataacagaaagtctggagcaaggcaggcttcccctctcagggagtgctggctggggggtcatcctagaggcagcctgggcctcacagaatccacagtaggaacattggcagaacttcagcaggtgtggccagagagccatctctttcaggtctctcactcgccaagggtctaaaattcataccttcagtgttatctccgaacaagttataatagtttgctagggcagccataacaaagtaacacagattgcctggcttaaacaacagagatttatttactcacaatcctggaggatgggagtcccagatcagggtgttggcaggggttcttcccaggcttcaccctttggcttgcagatggctgtctttccctgttgtcctcacgtggtcttctctctgcgaatgtctgtgtcctaatcttcttttcttacaaggacaccagttatattggattagggcctactctaatgacctcattgtaacttgattgcctctttaaaggctctatctccaaatacagtcacattctgaggtactaggagctagcacttcaacatatgaattttggaagagacataattcagcccagaacacaaggttaggcagacagtcagggaaatattcctggagaatataaaaatgttcatcatgcagcattcttttaaaaaccatttattcttttgaatatgtgacatattcacatggtacaaatttgaaatgctacaaaaaactatagaaagaagcataattttccttcctccctgaccccagtccccatagaagccatgtgatttatgttttgtgtttgactctccagagagagtctttgcacatatgtgtactcacacagagcacactctctgttctgcaccttgctttttcaactaaaagtgtatctttgaggggacttacttgcctaagaaaaaaaagcaggtgcactttcctctattcatcctgttaagtgcaactaaaagcctaggcattgtatgcaagacaaacatacggagttcctgcaagatagaggggaaggcaaaaggctagagacctcagaacccagggaataacatggtggtgggttccttgggttttctttttgcctcatatatcccagaattggatgtgaagaagccagcactcccagaaacatgaacaggagcagacaaaatcgaagctcaaacagaatctgctcccaataactactctacattagccaaacactttacacacaaaaacttgaagcctctaacctcactcatgacagaaaagggcaaaagaagagcctagattttcagtctcatgatgttttaacaaggcactccaatattcctactgatgtcagaggtggccagttaggaagccaagaatttcattcctaccagctgacaatgagacctccttcccagcaatatcactagagaccatgtggggagcctggactttcactctcacccagcaaaatggagagcccccttctcaagtatcaacaaagccaaatgtgaactcaggagttctatttctgcctaaaaatgacaaggcagtgtccccacttcccctgctagagcagtcattaaaaatagctaaaacactcagattcatagcctcattgcataaaactaaaatgtccagatcttaaaataaaatcacttgtcatatcagaagccaagaagatcacagactgaatgaggaaagacatttaatagataccaacactgaaatgacagagatattagaataatctgacaaagattttaaagtatcatgataaaaatgcttcaacaaacaatgataaacaggcttgtaacaaatgaaaacatagaaagtttcagcaaagagatagaaagacaaggcaaaaattgaaagatataaagaagaattaaaaggtaaacttagaattgaaaaatacagtaaccaaaataaaaagttcagtgttcagtggatgggctgaacagaaaaatggaggggataaagagaataattaatgaactggaagatagaacaatagggattactcagtctgaacaacataggagaaactgaatgtgaaatcataaacagagcttcatggaccagtagaaactcaacaaaaatctaaaatttgtgtcactgtggtcccaaaaggagagacaagaattgtgctgaaaaagtagtcaaagaaataataatagctaaaactccccaaagttgggaaaacatacaaacctacaaagtcaaaatgctgagcaaatctcaaacaggataaaccaaagaaatccacaccaagacacatcatattttaaatttctgaaaaccaaaaacatgaaaaaaatcttaaaaatggccagagaaagacaatatcttacctataaaagaaaaacaaatagaataacagtgaatttctcattagaaaatatggaggccagaaggaagtagcacaatattttcaggtgctgagagcaagaactgttaatccagaaacctacatctagtgaaaatatcctttaaaaatgtatgagaaatgaagacattttcagatgaaggaaaattaagagaatttgtcatcagcagacctgccctaaatagtggctaaagacagttctctaaacagaaaggaaacaataaaagaaggaatcttggaacatctggagggaagaaagaacatggctaagtgaaaatatgggtaataaaataggtggtctttctcctctttggttttccaaactgtgtttgatgtttgaagcaaaaactctagcattgtctgatgtggttctaaatgtatgtagaagaaatagttaagaaaattattaatctagtttggctctgtgtccccacccaaatcttatctctaattgtaatccccacttgatgagggagggacatggtgggaggctattggatcatgggggcagtttcccccatgctgtccttgtgatagtgacagggagggagttctcacaagacctgacattttaaaagtggcagtttcccctctgcattctctttctcctgccaccttgtgaagaatgtgcctgcttctcctttgccttctgccatgattgtgagtttcctgaggcctccccagccatgcagaactatgagtaagttaaacctcttttttaaaataaattgcctagtctcaggtatttctttatagcagtgtgaaaatggactaatacaattatattatacatgggggagagttaagggtcattaagggaagtgaggtatcatcctttactcaaactctaaaaatggtgataagagtagactgtaataaattatgtatataaagtaatatctggagcaatcctaaaaaaaaataccctacacaaagagatgcactaaaaaacactatagataaatcaaaactctacatctttgtaaatctaaaaatgtccacataacccaccagaaggaagaacaaaacagagaacaaacagaaaaataagacttaaggcctatcatgtaaataatcacactcaaacacatcaattgaaaaacagagattagtaacatgactcaactatattctgcttacaagaaattcacttgaagctaatgatacaggcaggttaaaagtaaaatgatagaaaaaatatatatccatgcaaacattaatcaaaggaaagcaggagtcgctatgttaatataagacaaagtaggcttcaaagataattatctgagctagcaagggatatcatacaatgataagtcaatttaccaagaagaaatagtaattctaaatgtgtatgtctcaaacaacagagctgtaaaatgtgtgaagcaaaaactgatagagctgaaataagaaagagacaattcatagttatagttgaagaattcaacatatatttctgaacaatcgatagaactagaaagaaaaccatcaagaatatacaaaaactcaacacaatcaaccaacagaatctaattggcatttatagaacacatcacccaacaaaagcaaaatatacatcttcttcacatgcttaaagaatataccaagatagaccatagcctgggctataaaataaacctcaacaaatttaaaagaaatgaaaacatacagagtatgttcttcaaccataatggaattaaactggaagtaaattacagaaagataacagataaaatctctaaacatttggaaactaaacagcatacttctaaacaattcatggttcaaaaaggaagtcttaaaggaaatgaaaaattacattgaaatgaatggaagtgaaaatatgacctaaaaaatttgttggacacagctaaagcagtgttgagagggacaaatttagcagtaaattcatactcaagaaaagaagaaaagtctcaaatcaattatctaagctcccacctcaagaaactagaaaaataagagcaaaagaaacccaaagtaaggaaaaagaatgaaataataaagacaagaacagcaatcaataaaactgaaaacagagagcaatagagaaaagtcaataaaacaaagagttggttctttgaaaagatacataaaattgacaaaccagtagcaagactgaccaaacaaacaaacaaaaaactaaaacaaaaaataaagatgacacaaattagcaatattaggaatgcaacagaaaataacactatagatcctgcaggcatcaaaaggataataaggaaatactttgaactctacacacataaattttaaaacttaggtttaatagaccaattcctcaaaaacccgcaaacaaccactattcactcaatatgaagaaaataatttgggtatacctataactattaaggaaattatatttgtaattttaaaactactccccaacatctccagatgtttcactgaagatgaaacatcccgatgtttcagtggagaatgctatcaaacatttaaagaagaattaacacaaattctatataaatttttcctaaaaacagaagagaagggaacacttctcaattcattttacaaagttagtattactctctattcaaactggacaaagtcaatacaaaaaaagaatgctaagaccaatatccttcatgaatacaaagccaaaaatccttaacattatatagcaaatagaatgcagcagttgggcacagtggctcacacctgtaatctcagcactttgggaggctgaggtgggtggattacttgaggtcaggagtttgcgaccagcctggccaacatggtgaaaccccatctctactaaaaatacaaaaattagctgagtgtggtggcacatgcctgtaatctcaattactcaggaggctgaggcaggagaatcacttgaacccaggaggcggaggttgcagtgagccaagattgcaccattgcactccagcctgggtgacaagagcaaaactccatctcaaaaaaaaaaaaaaaaaaaaattcagcagcatatagtaggacaaagtgggatttattccaggtatgtagggatggttcaatttttaaaagtcaatcaatgtaatatacaatattaataggctaaagaaaaatactacatgataataccattccatgcagagagaggaatatgataaaatacaaccccaatttttgatttaaaaatattaggaaaataggaataaaggaaggaagaaactacaactaaccttatatttaatgatcaataactgaataatttttccctaagatcaggaacaaggtaagtatgctcactctcaccacttttatttaatctactgctggcagttctagccagtacaataagacaagaagtaaaaataaaaaaagcatacagattggaaagaaagaataaaactgtttttattgcagatgacatgattgcctatgtagaaaatctgaagaaatatgccaaaaaaacctcctagaaataataagagagttcagcaaggtcacaggatgcaaaataaacatagaaaaatcaactgcctttctacatactagcggtgaacaactggtaactgaaattaaaaatacaatagcatttacaatcacataataaaagaaataggtataaatctaacaaaacatgtaaaagacatttgtgctaaaaactacaatccactgacgaaataaatcaaagaagatccaaataaacggagagacataccatgttcatgaatcggaaatagtaaagatgtcaattctcaccaaactgacgtactggtttaaggccattctcataagattccagaaaaatattttgtaactatagacaaaattatcctaaaatgtatgtggaaagactaagaaactaaaaatgccaaaacaattttgaaagagaatcaatctgcccaatttgaaaacatagtatatagctacagtaatcaagactgttttattggcagagggacacacacctagataaaaggaacagaatagagaacccagatatagtttacataaatattctcaaatgattcttgaaaaggcacacaagcatttaatagaagaaaagtagcctttacaacaaatactgctgaagcaattgtacatacacaggtaaataaataaaccttgacctatctgacaccttatacaaaagttaactcaagatgcataatggacttaaatacaaaatgttatgctataaaattttaaggaaataaacacaggagaatatcttcaggacataggactaaggaaagagttcttagacctgacaccaaaagcataattcataaaagggaaagttaataaattaaactttatcaaaatgataaagttttactttgccaaaactctgcagagatcatacactaaattcttatatgtattttggcctatttctgtaacattgatctgcttttctgttcatgtgccagtagcacagccttaaagactaatacaactttaaacaggcacaatgaatatagacaatgaataaatgaacctttaaaaattatgtattttgttttgtgaatatcataagtatatgtcattgcattttttacattcaaggtgttggtttagtcagtgtatgtgtttaaaatacagcataattttggtaactgttataggatttcctagttttttaatgtgttccctaaaatatgtagaagtttcctagtcttcttggtccctgagatgccttgctggaagatggtataaaaatggtataataaaagaatagaaaacaagaggaagtgatgcatgagcaatgagcccttaaatattagggactaaaaacacggccccacaaatgctaggctccagtccacacccctgataggaccttaagttctttgttggtctatcctcagcactgagaattatacctgccacatagtaggtgctcaacaattttgtgttaaatgtaatttcctggggaagaaatgaatcagaagtaagagaaaggcagagtccaccctagcacttccactgggtagggaactattggtagaatttcctccttttctatagaaatgggagacgtagccttgcttcccctccaaatttccaggtggtctttctcacttgatctgaggataaaagacaaggagctcataacgggtcccagcatcttaaaggcaactttccagtgtgtatatgggggtggttagaactaggattagaactggcctgatgacatgattgctgataatctcactggatagggggtaatgcttggagctcacaggtttttgagaagtggtgtgcagtgttgaaaacagcatgggctctggactccgagagatccaggtttgaagctattttctgccacctaatagctgtgtgtcttttacttctgtcatctaacctctctgaatctttgttcctttgggagaaaattatcttaacttgatctaccttctcaggctacgatgagaataaagtgaaatgtttgtaaaatatttacatacttagtagtcagtcagcaaatgcttgttaaattctttaatggaacaaatatgaaatctttatcattttaggtactaattggaaagatgtgggttcaaagttgaactgatgaaagttcatctcatgtgtctttcaggatgatttaaatagactcaaactagactgaaaaataaagaaattgattatctgactacccaggaaatctagagggagggcaagcatcaggagtggttggttcaatggttcagagacctcttccatctctgcttcacactggcttcatcctaagggtggctcccttcatacttactagattgctgcatagaaaccgaggtcatacatagaacaacatcattagctcaggagaccctcaccccacacaaatcatatactcacccataagcaagcggcatagccaccaaacaacacacgttgcttgttggaggtagtgagactgagtcctggagccagggatgtggtcacctttccctgcgtggacagaaaattacatggataaaattgggattctattagaaaggagaaaggtggcaatgatgctgagtggatgctccaaagtttgaccagctgaaactgtaagcaacttttatttaatctcctgagatttagttttatcatttgtaaaataaagagtaaatcaaccctataatctcttattgggttttttaaatgattgcatgagagcatatatataaagcgcattgccctgaacctagaatgtagaaggtgttgaataaatgcatagatatttttattctttagggtactgaactatggtttccagagcagttagagttcttaatttccacatggggaaactgaggctcagagacattgtgtgactgttcatggtctgcacagctgggagaacacatctgacaccagactgctagatccatggctcctggtgatgtgatccatgtcctccagttccccccgctttcagggggccccaggggagaatgtgaagctcctagcgggtgggggatggctgcagcagcaggcagggaagtcacaggatggccctttcttgttttggccccacagtgggtctaccaaggaggcgctgacatcctctctcagcagctcagcgcatatgagccccaggagtcccaggctgcccagacctgcttactcagataggcttcccaacccttccaacgcctgaccaagaaagaaaacctccacataagcatctcgctattgccttcatgttctgctcaggaagtggccctcggggagcaaactccaataaaccaccttcagaaaatggagctggtgactggagaggccagcccttgcctctggagaatatgctgacactgggcttcctcctgcagtgacaacatcaatcagaccctcccacaaaaaaaaaaaaatgctgaattcatctaagtaaagggtcccttctgaggtcccgcttcccattgcaggctgagcctgcccttttgggtacttgaccccttccttattacctgcagtcctttcccacagtgggaaataatcttggatttgatctgccatctgcgcacagggaggcatgctggggtggaggaaagaaggcaggaactcagattggggtcaaatcgtagttctgctacttcctaactgtgtgactgcagccaagttacttaacctcgagcctcagttttcttgtctctacaatgagcataataattctgcctacttctacctaagttgtttcacatcatgcctggcaattaataaggactcattaaatagcatttttttaaaaaaggaagttccatatttggccttataatttatatgtgtgttaggaaaatccactatctattcaacaggcatttattgaatgccttctatggatcaagcattgtactagtcactggggacattatgagaaaacagttattgagtcttgttggggaaacagtattattcaactaaacacaaagatgtttattaaacaaatgtgtatttaggcacctaagcgctatacaattgttaattcatctgatccttataaaaatcacacgaggcagatactattcattcccctactttacaaaaaagaaaatgggggcatagatggattaacttgcccaaggtcacctgtatcagttagctatagccacataataaaccagccccaaaagttagtgccttaaaataaccatgtattggttctcacaagttgttggctgggtatcagctctgatccaggctgggctcagttaggcggttctcctgttctcatccatgtgcctgtggcccgtaggggcttgactctgctccacatgcctctcctcctcttctgaaaacatcaggccagtccaggcatgtcctttttatagggatggcagaagtacaagagagtgagcagtagattcagagctggtatcctgtcatttcccccctaattccactggttaaagcaaagcaagtggccaaacacaggggcaggcagcaagccctgcccacaggggagggtactgcaaactggcatgttaagggtaagcagagatgagtgaggaaccagggtaatgatgcagccctgcacatcacctgcccggtaggtggtggggccaggtgtgcactggcagtcttgatccagtgtcctgctcttatgcattaagcttaactgcctcttgtgtgtgtacaaatgagataaatgctgggaaagacaagcatggggtaacatgagtgtaaatcacaggggagtgctggagtctgggtagtctggaaaaggtctttctgaggaagtcatgtttgagaggaaaaggatgcatccaggttaatgcagcagagatcacactttgtgccaaggttgcaaggtggtttcacttcctagcaggggagggagggcctttgcaatgccccctgaccaccctttgcagccccccagcctccaaatatgtcctctcatccaacgagcctgtgctctgcctagccacgcaggactgctgaccttccagagacaaccctgggcctgctgtcttccattggtcaatgctccctcctggactccccttcttcttccgaggccaggctcaaaggccctctttgtggagcagcctgccctgatcctccaggtagaattcaccccttactaccaccagccaccggaccagtcacgcattctgaccacggaatgcatcacacaactttgtagtgattggctttacggaataacacaaaagatggtcattgagcacgtactggttggacttccacactggaccctgagtctcttgaaagtgtgggcacatacacacacacatgcacacacgtgtccccacaaatgtacacacacacacaatgcacacgcacacaccacgaagaggtgatgtgaagaggaaggtggagattggagtcatgtgacctcaagccaaggaatgcctgcagccacgagaaactgggggaagcaagaaatggtttctttcttgattctggactcatggcttccagaatttgagataatacattttttttgttttaagccactcagctcgcagtgaattgttacagcaaccacagaaaactaatatgcccctctttgtccattaaaggaagaaaattccaccaacattttagccttcttggaggagctggggaaagggctcagcctcggctccacccattcaggcagaatgacttataggatgggcccatcttacccatgggtgcttcagaagcaaaagtaaatcaggctcttccctctcttcccagccctgcgggcccctgcctgctctcaggggagctatggctggttcctctttcctgtcccagagagctaagcctttgttcatccaattccagtgactccagagagattccccagctctgtaatcagaaacaccttgtggtgtgtggccttgtggccatctggtctttgcaattccaaccccaacttcatggaagcaaatggtcaggtcagaccaccctgtcactagagaagggaagaggcaggaaaaccaaagccacatgctttggcagagatcccaggagagtggtccatcagcctactcagacgcacactcgtgtgtgaggctcgccatggagacaggtgcagaggactctgttctctgtttggggagctcatggatcaataaggcatcatccaagcatcattcagtcattcatcaaacatgcctggcaagcctcctctgtgctgaggactgcaccagctgaggccaagggaggccatggttagagcaggctctggtgccacactggctggggacacggttctgccgtgacagccctcgctttgatgatgcaacatggggacaataatagcacctgccactggaggttggggtgggattgattgtttacaccccctcattcagcccctttccctccagagttcctgccagtggattctgcacacaggacactgaaccaagagaggcaaatatcggctttgttatctttgtagggcacagcacttcttggtacactgaaagtggcttggcccccaggtcaaaatgcaagtcttccccatgagtacaggggccttcctagctgctctgcctgcttgctggtggagatgctggacccaaaggggcagaggctggctttcagcctgtgagcagaagaacatgggttcttattccaggcacgctgtgtggccttggacaggtagcttaacctctctgagcctcagctttctcatctccaaaaagatcattatgtgggtcttcctgtgtggctgtgatgacaaaaactgaagagaggctctctgtggtggccctatcctcagtgtcccccacaaacaggtgcactgcaattccctccgtcctctcctgagacagagtctgagccaaggacactgtcccaggctggcaaagcaggggtgctcctgaagctcgtccctccaccccaccacccacctctttcctaccatgccccagttctggccctgctctttctgtttcaggcctttcccttcttccccttccgcttctctgcagctcctggctgggccccttcatcttgtaaacgctgcaatgagagccctgacagccccactggctccctggagagggaacagtcactgaataagaaaatgtctattaaggctgggctggagctcccatcattcacatggcatcggctgcattcagcaaatgggcttagactgtactcacatccttaatgggagactgggacagaaataaagcaagcaggagctctgggacagcctgggggcagagggggagctcaaggagctctgctactttccacgtctgtgatcatgggcacctcccttctgtctctgcacctccatacttccatctgggaaatggggcaacccccttcactctgctgcattaatgtgaggctttgaccattcgcttgaaaaacccttgattttattccttgaagactctatgcattcagcaagatcgtttgtcctgagagtgaccgagaggctgccctggcccctggggctgcagaaagggcggagagccaggagccttggttctgggtcccactcctgggcctgcagcctaaaggaatgacaactcagccctgccctttccttcagcgtacatggtgggaacctcccagcacagccagcttcagtctcaccatcaagaggtcctctaggccctgcgttgtgccggagcaggtcagggaatggcttcccctcccggtctcctcccttctcctctcctctcctctcctctccccaggctgcagcacacagcaagcccctcccccagggtgctcctcctccccggctggctggttgaggcaggggttgttgttttcatcccaccttcctctgccatcttccctgtgggctagtcagcaaacatgtggttagtctggggtcacgctaatgtcctcaaatctcagttttcagggaagttactccttcccttaatgccacacttccttagccagaggtcctccagggtaagaccaatgggagcaagtcccaagccaggggatccgggtaccagctgtcctgactgcaggctgtcacctctcactccagctgctgctctgacttcctcccatcacctctggacagctttgaatggccttcggggagctgcaccttcaatttccagtccaaatatggaccagaggaaccacaaacacagttggcttaaggctgttgggttaagagacttttccgagttttgagtgcaacatacaggaattattttaaaagaagcatctaaatatcagtatgggatcttgctgctcctgatgttccttggtcttgactctatttggagggaaagaaggaagtgcctcatggacatttcctccttttagtccccagttgtaccaagttgtagcatcctgccctttgccatttgtgccccacacccccccccccaattctctaattctgtcactggatcctactagaggaagcattagttcatggcagcaattgggttccctgtgaagctgtcccagagaagtttagcctgaggcatccctgaaagggctgacagcatgcccagcaaatgggcgacaggtccttccctgaagagggttccgggcggtacatctcccagcccatcactgctcacaccttaattatgtctgcagggatcaccttgtccacagtaaagacagtctttgacatttttacacaaaacagtcactgcattgggattattcagcgctgctccaagaacaccgggtaaacactgtccttacaattgtctggagcaccaaaatgaccacaatattgtaccttctggaacaaagctggagtcagcccaaagacagggtccggttccattcccagagccaccaagagctgggagatcagaagtatttctctccgaagctttggtgctccacgctatacccacgcagacctcccaacctgcatttctgtggaggctgtgatcactgacaggctgcctatttttcgtggcagtcccaggcttacttacactctatcctttcaccagggaaaaggcagagggtttctttgccagtaatttgcattcctgttaaatttcattagctctaattggtctggcctgggtcatgtgcccatttctgaaccaatcactgtagctagaggagaatgccatgctctgattggccagctattcatgttgctatgcccatcccaggagaggagaatggagaacagagtttgagtcagaaaactaatcttggatttaagaatggggaggggtggttctccaaggaaatctggggtgctgtcactaaaatgaatggaatggatgctgagcaggcagataaaagaggaatctactcagtggttgagcctttgccatagtgaaagcagttggtgtggagtggatcctcagaactaggtgctcatccttcggtctccccgttaccctggcaggttttctgggggtaccttcaggtcctgtctcagctctggcttgggatctccacggtgtccgtactcactgggggcttccagaagttcatgctcaataccgtgaatccccaaacctcgagcaactgctcagggtttctgcagtgtctgctagctttgggtaagggttaggtcactgattctgttaacgatccattttagggtgctagcattcatccacaggcacaggatcccaccagcctggcccacaggacttgtgattaggggaacccagttgtgcagtcagcagcaaggccctaacgattgctcaggcaagagtcatcccctttctgagcctcagtttccttctctgaaagattaaatggatggtcactgtgctccatcggctctgagattgatgggcctcccagcttgaaggggaggaagctcacgcctcttgaatagctactgtgttggcattatctccatatatagcaacatacattcctcacacagtgacccttggagaaaagtatttaatctctcattttcagctgagaaaacagagagaacagtttagacaatttgccctggggttatagagccaagccttgaacttagtgtgtctgcttcctagtcaggaaagcaccagccagctcagagatggggctctgtcaaccctcttcccataacttctctctccctctccctactagagagagctccgggaagagttagttgcaaagtgggagagatttatgtctcctgtcctcttgggcaggccctgttcctctctggtgacaattgcattcttggcatttccatttccctcctggaaagcagccttgtcttatgtgttctctcacacttgccctcttgttctttagttctttcttgcagagtgacattaatccagtttgggggcagtgatagctgaaaaacagtcaacgtgagggctggaaatagcctaagaaatcggcaaatgccatcccctgcttttgcttctctgcacctgctggagggagagagccttcattatcacacatgtaataaaaataaatgtttattgactgttgactgagtgaggacaggattcatggtggctagaacagaccttatcatttaattcaatacattgccatgcagtttaatcaagaagggtgggtgaccagggcaggctcccaccagctgggaagtggcacagcagggacaggaggaggtattcaagctcctagcacatagaattacatcagaaaatgcacaaaagccaaagtcgaagtcataattctctgccccttattcccactcccagtctcttagcatttcaaatgcgagaaaacagaagagaggaaaggaaatccagccataaactcctgattcagaagcaaatgtcaatcccaagaacagggcagtccctcttcccagctttcaaagtaacattcctgaatggaacattcatcaaaagcctgtatagcagacagatcaatcagtttgcctcccacacccaacttccccttctgacttaatcagctccacttcctctgcaaagagcagtcatgtgacctcaaccctaccacagccaattggaccaagcatgaccacatgactcaagactggcttgtttgtgggctggactgagtcaatgaaacgctcagtgagaggaactgagtcacagaggtcaggggtggtagctattcaacaagaagatctggagagctgtagttgggggtggtgtcttgctaagccagaaccatgagagatggagtagtgtggtctgcagaaacaagagggtatacaggctgtgagagatgccaagctggaaggccacgaggccctagagagaaggggctgaaaaagccagagactcctctatgtttcctgaagctctgtcctataagtaaggaaggtgctaaatgcattcaatgacccttccatttactggggctggataactggtgtattagtccattttcatactgctataaagaactgtccaagactggttaatttataaaggaaagaggtttaattgactcccggttcagcatagctggggagacctcaggaaacttacaatcatggcagaaggcaaaggagaagcaagacaatttcttcacaaggctcagcacaggaagaagtgccaagcaaagagggaggagccccctataaaaccattagatctcgtgagaactcactcactatcacgagaacggcatgggggaaaccaccccgtgattcagttactcccacctgatatctcccttgacacgtggggattatggggattacaattcaagacgagatttgggtagggacacaaagcctaaccatatcaactggttttcatgataaccaagagagctctgcctgggacagcctaccatgagtcaggtgtgaaagttgatcatatgaattgggttattcctttttttttttgagatggagtttcactcttgttgcccaggctagagtgcaatggcgtgatctcggctcaccacaacctctgtctcctgggttcaagggatcctcctgcctcagcctcccgagtagctaggattacaggcatatgccaccacgcctggctaattttatattgttagtggagatggagtttctccatgttggtcaggctggtctcgaactcccgacctcaggtgatccgcctgcctcagcctcccaaggtgctgggattacaggtgtgagccaccgcacctggccctcttttttttttttttttttgagacagggtctcactcctggagacagcctgcaaggaatgacagattcctaagaagggaagaagagaccgcaaagagaagggtcctaggactgaccctggggacacacagactttcaaggcaggagaaagtggtcagacagaagcaggggacccaagggagtagagacttttggaagtcagggtaggagagaatgacatgtcaaagagttagaacagaaccacgccacctgctgctaagaggcaaacaagaagagcatggtgaaaaggctttgtgttttactccgttgagtgaggttgactcaaccaccagcacttagttgttataaaatgaggcatagcctactgttctttaattatgcaatttaattaagtacctttttctcccctttacctgtttggctttacaatcatatgccatccaagactctgcttaaaaaacgcagtgtgggcccggcgcggtggctcatgcctgtaatcccagcactttgggaggccgaggtggcaggtcacgaggtcaggagatcgagaccatcctggctaacatggtgaaaccccgcctctactaaaaatacaaaaaattagcatgtcatggtggcacgtgcctgtagtcccagctactcaggaggctgaggcaggagagttgaggggtggaggttgcagtgagtcaagattgtgccactgcactccagcctgggctacagagcaagactccatctcaaaaaaaaaaaaaaaaaaaaaaaaaaaggtgcggtgtgccattgaaatccatactttgcagggctggttcccacttccctcaccctagtgtattcccagcttcagcttcaaagatacatctcaaggcttggtttaagactgttaactactcccaaattaagatacattacgctcctccccatgttcctcctccactatgtctgctgggctgaaaacaaaagaaccatttcaaaatgcaataaacactacatgcaaattagtgccccaaataactttgggtaatcattttggagaaccaaagctgcttagaataccaatgctgggcaggcaggtttgcatgaggaaagaaatcccaggtggccctgtactagtttggctaagagaggatgggtaagtcaaaggaaaacgttatcacagagacctgagcctttccttgaagattctccaagaaaataccaccagtctacagctctattttatgagctgagttgggactcccacttaccaatgggcaccaataaagtctcagcccatcaatggttatggcagctattggctgtcctctgcctgctccccaagcactatgctgtgtgtcttcacaatctctatctcacttagtcctgcatgggaaaatacaacctccactttacaaatgactgaactgagtttctgagctcttaagtagaacaggaactcaatttcatacagccataaccagaaatctttatccttatgtggcctctctctgagtagattttgtttcatgttatatatttgttcaatgcctaggttgagaggggacgatagagtggggtgaaaaggatcagaatggggcatttggagaactgggtgttggcaccagcatggacctgctttgtggttctgggggagtcacctcatgtccatgtccatgggcctcattttcttcctctatgaaaatgaggggatgggctggtcccattgtgacctctcctactcaactttgcaaaggtggcaggatagaatttaagttcctttgtagcctcactcattctcatctcccacccctccctgacaccctttcactgctgctgcagccatgacaaaggttggaggtcccctggacagcccccagcctttgcacctgctgctgcctctgttagggggccttccagcttttctggttggcaagcttctcttcatccactgaagccccagctcaagtgtcccctccccgtcacagtctcccagactctaaaaggaagttctaatagagccgtccccccctcttatatccataagaatccagttcacagctgtccgttggagcactctgaaatgctgtgtcattgtctccctcccttctccatgacccagggcaggagatgggctgcactggggcaccattgcattgccaccctcaggcccagcatctagcatataatgctttctagatggtgacagaatgaatgcccttccaaggcaaacctcatctctggcatcttaagatggtatgaatttaactgtgctcctggcagagcagaaaatgccaaaacgagagataattttaccttccctgtctatttgtgtttctctgtgtcattgactttcactcctacactctagttcctcgtcagcagacaagccatcttgtgagcgtaaataaatgtcagtcatagctgggattccctcttctcctgaaacaaagcctccatgagcctgcgttggaacatggaagggcatgatatctttgtggctaagattattttaatttggagatccagtcacccagcaaagccccctgctcctaaatatccaccatattgggaagccatggtgtctcagggcaccgttagtaacttatagtgaggaaattctctgttcaatggacgtgtcatatggaaaaatatcaaagccattaactatcattcagaagtattttgactcactcatcattcatctgtttatttattcatgtattcacccattcaagcgtttctataaactgggtacaaatcattttaacttcactcctgagaaaggttccacaatggcttattgacccaaggttaccaattaatatagtaatagctgatatttatggaatgcttattgtttactgggcactgtattaaaaactttatatatgttaatgtatttaaccctcacaaaaactccactagattggtatcattttttatcgtctttattttgcagatgagaaaactgaggcacaaagagattcttagcttgcttaggaccacatgtctggcaatcagcagaggtggactaagatcatcatatgctcttaaccacaacctgcacccttaggatgggaagggaccctaagagacagtcacgcccccaagggtctcggcagagtctaaggagcatcagacaggagacagaacccgtgacttccatccaaaactatgcccctggccaagtatgtcaccttggcaaagcacgtggccctttgagtaacaatgtggttttgttgttcttgctggttttcattaacctactaatatttttaaaggcacttggattagaagatgactagcaaagccagagggctctccagcctctacaattctgcaaactagatcttccccaccccctgcaaattattaccggtactgtcaaggtggctgaggcttaatgtctgaaatcgacatcagcagaaggcaggctgtgctctgagcaggctgctctggagggcctgacaccttgtttcctggggatataatgaagatgggggtactgtggctacagcctttgattaaaccatttccaggagggtgtagggaagagaggcctgaggccatgaccttggaggagcctgttgaaaatgcacatgttccattttcacagtgtgtcccttccatcctgtccccagctccaacttctggcactaacactggttagaatctcaagggtggctggagggtctctcacacggggcagggtgatgctggccaaaggggttttcagtgcgcaggagacacagaggagaataatgcacacgccgagccaggagaagtaagctggacagtgtcatttttcagatcaagtgacaaggtatcaggtcattcagtgttaaggacaaggtcttcatatatcctagtgctgccccagaaaggccatgtgatagggcggagcgagcacaggcccacacggtagtcacatggacttaaatccaagtgctgcctctcattagctgtgtgtccatgagtgggctattggcatctgtgagcctcactttcctattctataaaatggggaactctctccaactttcagggttgtagcaacaattagaaatgacgttagtcgaatgctcagctctcaacttagcacaaagatgctcaatgtttgttttgttttgtttttttgagacgaagtctcgctctgttgcccaggctagagtgcagtggtgtgaactcagcttgctgcaacctccacttcctgggtttaagtgattctcctgcctcagcctcccaaatactacaggcgcacaccaccctccccggctaatttttttgtatttttagtagagacacggtttcactatgttggccaggttggtttccaactcctgacctcagatgatccgcccaccttggcctcccaaagtgctgggactacaggcatgagccactgctcccggcccaataaagtggagttctaagaccactgcagcaagtgctggtcattttgttcagctgaagtagaggtgtgtaaaggggaatcagaagatggggctgaaaacacggccagggaccattccctttttcctgtattcattccatacagactttttaggtactgaccttgagccagggataggctctggtatatagcagacacagttcttgccctcgggtatttttcttgaatacatctcttctttgtgttaaggaagtcctcttctatttctattttgctaagaggtttttattttttaatcatgaaaggctatgaattttatgaaaggttttttctcatcaattgagatgaatatgtattttcttctttaatatgtaccatttaaactaaaatcttagatatggaatttggggttaaagaggttagccactcgcaatgttggaaacatgttgctaaactgtcctttagaatgattttaatcactcataccccccatcatggtagataagcatgccaacttcagcacactgtgataatcatcagttattttcatcatttccatctgacaggtgcaacatggagggtttgttggttgagtccttctgagaagcagatgttgcgatgggattagacatggagagagttagtgaggaaggggaggggctggagaaggtgggaagggccataaaatgcagcctcagtaaaagaggggtgagtagacagagcatcagactgccctgcatttccaagaaactttcagccaggccaacttggactccatccaagtcaccctcagaggagtgtcttgtcccaggaagagacctgcattcctgttcttggctgtgagcagccctgggaagcatggccttgggacaaatgtggtgttgaattccagtcaagttgaagctgcccatcaatggtgcccccacagtaggagagctgagtgagtgctcagtgcatgttctcacggcagccaagggctgtttgttttattcttactaatttgttggagttctttatagattatggatattaactaatagaagcattgcaattgttttccccagtttatcgcatgtcctctgacctagttggagagagagggaaagattgtcataaaggaagggaattctaaatatttagacaagaaaagctgttttctaaatattttttggcttttattcccttccttctttccttctttccttccttccttccttcctttctattattttttttgagatagagtctcgctctgtcacccaggctggagtacagtggcgtgatttcggcttactgcaacttctacctcccgggttcaaatgattctcctgcttcagcctcccgagtagctgggattacaggcaccacccaccacgcccagttaattcttgtgtttttagtagagacagggtttcaccatgttggtcaggctggtcttgaactcctcacttcaagtgatctgcccagcttggcctcccaaagtactgagattacaagtatgagccactgcacccagccaattcttccctccttccttttcctctctttctctttctgtttctctttcttcttctccttctccttctcctcctcctcctcctcctcctttcctttcgtcatgtcaaggaaggctcttctttcccctcacggtttaaaaaaattattcttggctgggcgccggtggctcacgcctgtaatgccagcactttgggaggccgaggcaggtagatcacctgaggtcaggagtttgagaccagcctgaccaatatggtgaaactcagtctctacaaaaaatataaaaattagctaggtgtggtggcttgtgcctgtagtcccagttactcaggaagttgaggcaggaggattgattgaacctgggaggtggaggttgcatggagctgagatcatgccactgcactccagcctgggtgacaaagtgagactccatctcaaaaaaaatattatcttgtaagtatgaactaaaccatatgggctcagccgaattggatggccagtctgcaaaaatgcaggggtggaggcacaggctcggtgacaccactggacatagtcagtggaacccagacaataggaaactgcacaccagtgacctggcttcttcaacagataattcacaaggataaagggaaaaaaggggagtcgtggggtagaagggactcgagagccatgtcagataacttcagtaaatggatccctccctccagaaaagtgaaacaagaagggaagtttgaaaaccgactgaatatttgctataaaaatatagttatttgttagaatgatgatggaactgagattatgttcaaagaaagacgcctgtgtattttggcgccacatgcagggatattttcacatgaataagtctgggatctgttccaaagtcacccgaagtgggcccaagtgtgtggggatacggatgaagtggactggccatgatgcttgttttaaatggagggtggtacatacatccacaggggctcatggtaccatgttctccatctctgtatatatttaaggttttccataaaaaaagataaaaactataatctaccagaaacacacacacacaaacacatgtacacacacacaacacacacacacacacgaaaacaagagagcgccctggagcccaaatttcagggtctgaacgtcatccccacacttgctagctggtggccctcaatggagttatctaacctctttgtatttctgtttctcatacataaaatatggaaactattatgtcttgtgtcatatccctgttttgaggattaaatgagaaaaaaacaggtaaagcactcctctatggagaatccagcacataaaaagcactgcattaattgatattacaaatgtttattgagtgccttgaatgtgtcaggcactgtggccaacacagagactatctagtcttttctaattattaataactagcattattattttgtgattctatttcctacatttccatctttttccatctggatttcattttggtataaggaaggatgcagggaattttttattcgaatattttgtcaattatccaatgtcatcattcatcaaatagtccttttttctccactgatgtgaaacattctctgcttcatattctaaattcacatgtctatttctgagctctctatgttctttgatgctcttctaaccatgtttttgtctgatcacctttaggaatctgtttttaatatttggctagtgtagatgaagaaaatattagtttaaaaaaatttttttttctaatttaagaaagcagaatatttttatttccactttacttagaaaggatttttggcttctgtccactagatctttccacaaaatacagagcaaattgtagaatgatccgctgaactcagaacaataagagaagagtgatccatcgtcagagccgaccagtgagaaggagggagttaactgggcttccgcaggtaatacccaagtaaggccatagttaaatccacggtcccagccttttgcatctttgcccaaggtttttcccgcttatttatagggttagttaagttcaattttgtttgctttgtgtatttaaaaaatttaattgacaaataataattgcatatacttagggagtccagcgtgacattttgacctatgtatacattgtggaatgattaaatcgtgctaattaacatgtctgtcatctcacatatttatcatcttttgtggtgagaacatttgaattttacttatttttagcaattttgaaatatacaatgagttattattaactatagtcaccgtgttgtgcactagatcgcaaaaacttattcctactgtctaactgaaactttggaccctataactaataactccctcttgtccctccttccacccctagcccctggtggcagagcagtacatctgagctctacatcattggattgttttaataattctttagaaaacaaatgcagctccaatttctgtgtatctgtgcaaagtgtctgaagtgtctgtgcatgtctatgacaagcaattcttatcttttctgatacacctgtaggagtagataaagttgatatttattgagtgcctattataagcatgatactttatatatgtaccaatgaccttttcgccttgggctggctaaacttttttggctgtgaaaaggggtaggagagtaattgaggtggcaacccactacagttgcccaaaaccacaatagttacacaaactcacataggccaccaagactatgaaatctgcctcccccagcccaggccccactgtggcaatacagtaagcagggcatttgaggcaatgtaggtttagaagcaggtagcttctttccagttcacaaccaacccacgggggaaccaacaggcattcctgagatgctctcaggcatgtggcccaactctctctctctctctctctctctctctctttctctctcacacacacacacacacacacacacacacttctatgatgtactcaagtccttccaaatatgttctcctgtctccatacaatttcccttttcatcttctatcaaatgctacccaagtcccactccagtgccttttccaaggaggagcacttgctctgtccccatcactgtttacatcacctgtgtgaggaggaccccctatgcagggaaagcagggtggatgcctgcacaccttggtcttaagcagattttcctgtatctttggttgacattaacttaaagtcctggctaacatcatttctgaggtcacaagaaggccagcactttgcagcctcctcctctcccttatcttacctgtattttcttatatcttactgaccatgacattgccttatccctaatttagtactttatcttcctactgccacaacagaagtgtttccaagtgtgcacatcccataatttcacaaactttctactacttttcataggcttctgtagcagtgaaacagcaaagaagtgacataactgactccactttttgttgaagggttctttacccattactgcacataggcaaggataattttagagcactgagataatatgcaacaacagcaatcatgtggtttttaaaactaactttagggttaaaggggaagtatgtaaacaactatgtcttgttcaaagatttataggagcactgtgaattgaccaaagacaaaaaagttcttagcctcctcggaagcttgccggtccccagatgcctgcagttgttggtcacctcttgatcccagtcctctactcttccccctgcacttaacataagaagaggctgaaatttgtactcacttgagatgttctttgcaacaccagtccactatctccttaagttgccagctgttgaataaacctgcatttcctctcatcaactcttgtctctggtgtttggcttttgagcagtgagcagctgaacttgggttcagaacttgaacctactgcatttagtttttctaatgcagtagttttccttcctgctcaggaagtaggtttcctacccaaaatgtgtatattgcttttttttgaactcttacaaccatgagtcactttgcaagatacagagggaaaaatgaggctcaaagaggttaattcaattaccagggttgcttgctggataaatagcagaattcaagtgtacagatctgacacttgatctaaaagtcagcattttccactccagttttctgcccctacctcccctgcccccatcacttatggcatcacatgtagtaaagggacacaagctaatggcttgggatttctgggcatgagaattctgtaaacatggtgtgggtcttgttctttatattggtgttatctggatcagatgttttgatcttctgaaaaagtccagggaaatttgatcaaaggcgcttaccccaaatataactagtcagtgaagtccttgagaagtaaaatcgaatcctctaattgaaaaattcactcattagaaaagactttgaattataaatagagtcagataatggatcttataaggagttgtatgtatgataggattttctcttattaattcatttttttaatggaactaaaatgcacattgattttcttcttatcattcttttaacgactctggctaaatgggaactgaacagatgaatgacaaatggaacattccaacctgtctctgggctcatgagacatagtcaagtttacagttttgggaatattcttagtatgtgacagaaattcattaggcaactaagcagaacacagtgatttgagtgggaagaaagctgtcttgctctggagggccagcaccaactaacaataactcctttgctctctcctgttccctcccttcatacaaagcctagtgacatgcaggctgagaggtcaacacgtttccatttgtgctgggtgtgtgcccaagtcatcagagcatgatcctgtgactgctttgtgaaaaacttgctccagcacattaggcaagccaccccgtctcagtgtccccatccctatcagtttcctggggctgctgtagcaaattcccaaaagctagatggcttgaaacagcagaaattaattctctcgtggttctggagtctagaactccaagatcaaggtgtgggcggggtttgttccttccaagggttgtgaggggggagctgctccacgtgtctctcctggctttcagtggctgctgaccatccgtcactccaatctctgcctccattttcacatgggcttctcccctgtgtctgggtctctgtgtccagatttctctctacttctaataacaccagtcattggattagggcctactctcattcgatatgacttcattttaaatgaattacatccacaaagatcctattttctttttaaaatttttttttaatttttaatttttgttggtacatggtaggagtatatatttatggggttacatgatatgctttgatacaggcatgcaatgtgaaataagcacatcatggagaatggggtattcatcccctcaagcatttgtcctttgatttacaaacaatccaattataacctttaagttattttaaaatgtacacttaagttatgattgactgtggtccctctgttgtgctataacatagtaggacttattcattctaacttttttttgtacccattaattgtccccacctccctctgcaattcctccactacccttcccaggctctggtagccatcctctgctctctatgcccatgagttcaactgttttgagttttagatcccacaaataagtgagaacatgtgatgtttgtctttctgtgcctggcttatttcacttaacataatgagctccagttccatccatgttgttgcaaatgacaagatctcattcttttttatgagtgaatagtactccattgtgtatatgtaccactttttcttcatccattcatcagttgatggacatttagattgcttccaaatctcagctactgtgaacagtgctgcaacaaacatgggagtgtagatatcacgtcgatacactaattttcttttttaggggtatatacccagcagtgggattgctggatcatatggtagctctatttttagttttttgaggaacctccaaactgttcttcatagtgcttgtactaatttgcattcccaccaacagtgagtgagggttcccttttttccacatcctcatcagcatttgtttttgcctatcttttggaaaaaagccattttaactggagtgagatgacatctcatagctttgatttgcatttttctgatgatcagtgatgttgtgcacctttacatgtgcctgtttgccatttgtgtgtcttctttcgagaaatgtctatttacttttttttgctcattttaaagatcagattattagattgtcttttcctatagagttgtttgagctccttatatattctggttattaatcccttgtgagatgagtagtttgcaggtaatttctcccattctgtgggttgtctctttactttgttgattgttccctttgctgtgcagaagcttttaacttgtgatcccatttgtccattttcactttggttcctggtgcttgtggagtattgctcaagaaatttttgcccagacaatgtcctagagattttctccaatgttttcttgtagtagtttcatagtttgaggtctttaattctttaagtctttaatttaagtctttaatccactttggtttgatttttgtatgtggcgagacatagggatctatttcatttttctgcatgtctcttattttcaaataaggtcacatttatagacactggaaagtaggactcaaacatactttttgaggggtgctatttaacccacagtaccattcttaattggggatattggaagaggtgttaatataacagatgagttctattctgccaagtactccggctcttttatccttaggtctaattacaacaaaacatgcttaaggacagtcagaatcagagggcgagaggttttcaaaaatctagacgtgggactctttaggtgtacagtgtcacgctgaggcataaatgctggaaagggcagccttgggataattagagtttgacttggagtttgtttagcaggaaatgtcatatttgtacttaagtttagaagtgataacctcgctgactagtttgaaataaaaaagggttcatcattttggttcaagtgctagtgctgacctgattgttgaaaagcatttttaaatagcataagataaaggtcaaatacttcataacgctcaaacttctgccaaatggggttggaaagattcgtgattccatagcacacagggaaggtgctgaatgctctacctactgctgtcctggctcaacctctccagtcatggctccttatctcttgaatcccctgtcacggaaagcctccacctcatcaggcagccttcctggcatatctttatctctgtgctttgttcttgctgttgttcctttagctagaactctagtccctcccaatgtatttcttctgccactggccatcttccactcccttccttgtccatttttccatgcaggccaagctcaaatgctgctgtttcaggatacagatgttccaatcattgttgacagcagaatcctgatgtcactagccaggggaggtcattcagtaatcaatcaagtattttcgaacccgttatgtggtagacacagtgctaggtgtagcggtgaccatagaacctgactacctcctcatctttgcctggtggatcttgaagtctagtaaggactctaataacacctgaaacagttattttatctctgaatgctataaagatgccatagaaaagttattgatgtgagctgaactcatgatatggaatttatttaatatagagtttactgaagaattaaccttagcccaatttcatgtgacaagttattacattgtatttcctcgaatataagatcttgtcttttcgaatgtcaatggtcttgaaatcaagctgcagcttaaaattgatttttaaaagagcttgtcctctgtgcaaatgttgcctctgcctgtcaggtgctgtcaactaatttgagttatttgacttggcagcaccacctagagttggattttatcttaaactgaatccctaattgtcacttgcaatgtcttcaaaaagattacattctagggcaatgttaaaacagaagttattacaggcagaagggcctgagtacagatctgcgggaggtaaatttactaagagtaaagccaataattgtggccagaggggtcccgcactttctcattgtcttgaaaaacaacaacctttcctctgggcggtaaggatgctaattcacaacctatatagcaaagcctttgtcttgttgtgagacacgtataaaacgatggcaccggtcaggcaatgcagttagctggcagcaagagaaatcgactgatcccttagaatggattagagaatggtaaagctgggagagttagtgtgaccggcccatgctaatgaaggacggtgacttaggagtcatgagtcagaatcttgctgatttccaagagaagctttctaccttccagcaatagaaactcaattaagaaaaaaacacaatgttgagtttaaccaaataggaaactcagacagagtgccaatgttcttcaatatgccttgaattaaggcattaaagaatgaaggtcatgaacagaaattatggaaaacagcatgtctccacactgctctgcatcaatgccaatggcctaaggtgagtgaaacttcagacactgacttatgtaagccctgggcttaaacttgaattaagaaactagaggagaaggtggcataaatgggtgacattgtcatctaaattttctttaatgtacatttaacagtgctacttaaaaaacaaatattaatgaatttagggatattttataatggttaaaactacagcaattccatttctgagtatatgtgtatatatatgtatatatatatatatacacacacacacacatacacacacacacatatatatatacatacatatgtcaaaattcattgacatcaggatctgtaagagatatctgcactcccatgttcattacagcatattcacaatagccaagatttggaaacaaactacatatccattgatggataaatggataaaggaaatgtggtatatccacacaatggaatattattcagcctttaaaaagaagaaaatcttgccatgtgtgaccaaatagatgaacctggaggacattatgctaagggaaataagtcagccacagaaggacaaatactgcatgattccacttatatgaggtatctaagtagtcaaactcatagaagcagagcataaaaaatgatgattgtcagggagaaatggggatttgatgatcaatgggtataaacatgcagttacataagatgaataagttctggagattggatatagtgcctatagttaacaatactgtattgtgtacttaaaaaaattaagatggaggctgaggcgggcagatcacaaagtcaggagatcgagaccatcctggctaacacggtgaaaccccatctctactgaaaaatagaaaaaattagccgggcatggcggtgggcacctgtagtcccagctactagggaggctgaggcaggagaatggcgtgaacccgggaggtggagcctgcagtgagccgagatcgcgccactgcactccagcctgggtgacagagcaagactctgtctcaaaaaaaaaaaaaaaatttaagagagtagatctcatgttaagtgttcttaccatagaaaacaaagacaacagggcatgaggaaattttgggtaagatggatatgtttattgcctgattacggtaatggcctcaggggtgcaagcatatgtcctaactcatccaattatatatattccatgtgaacagtttttgtatgttagttatacctcaataaaactgttaaaaacaaactaaattaaactaaaaatggaaattcttgttggattatactcatattattagcatttatcacttagggatttgcatttgagtgatatggcagaaaacccaaatatcaatgacataagcaatataggtttattgttctcataaaaaggtaagttcagaagtagacagtggccagcattagttcagggccagtgacatcctgatgttcttagtctagtcttgtttgtatggttgcaatatggtgcagtagttccagccaacacatctgtgttttgggcaggaggatggaagaagagaaaaggtgcaaaggagaagaatttgctccctttgaggagctttcttggaacccaccccaaaacttctacctacatctcactgactggaactctacgaaagagtagctggggaatgcggtggttatttgtaagctgggttccttgctatcttctaaaaattgagttttttaagtaaagaattcagggatagtggatatcagtgggcaactagcagcatcatagtaccttcttatgacactatggagagtgtttctctccatctgtaattgctcaaaggtcacaattcaggaagagagtcttccctatttgcggctcatatttcgtgatttaatactacacagatgcactcaatgataaaagcacaaattagtttgtcttccccaatgtgcagacttttctgcactgcacactccactgtggtggagggaaagttcatgtatccctgagtttggcaggaaggacagaattttgaaagtgttttagctggaaaaaaaaatctttctcactgcacagaaatcaataactgaaaaacccctgctggattgcaccatcaaatatctcctctggccctgacacttggagatttatctttaaccttccattttggctatttatggaattgaaccagcctctccaccaaaatagaagttgcatcatttgatcgctgaagttcctgctgggttttcagttgtgtgatcctcagtgttggcattcacggtttcctcttataggcttctttgtctgttcatctctcagcatttctttatttctgtcttgtgtgataattttcacgtttgcatccacaccatactgtgggctgtttgagaccagtgatcttcgttccttcatcccagcagcatcccttccatgggcatcttgtggatccttattaatactgcctaaataaatggagtcttcttgtggagttaggtccttgcctaaggacgctgtggactattgaaagcctattccctctgcgtctcccagtgttgtttctgcccatgatgatggttaggatggcaacaccaatagaataatgaccaccgtggaccaagttataaactaggtagcacacattctatctaatctttctacaaatctgagaggcagtgacagttgagagggagctgattcccagagaagtttagcccctcggccaaggtcacacaatgagcacttggcagagctggcaaacaaacccagatttgacttcaaagctctgtttgaggccgggcacagtggctcatgcctgtaatcccaacactttgggaggccgaggtgagcagatcacaaggtcaggagttcaagaccagcctggtcaatatggtgaaaccccatctctactaaaaatacaaaaattagctgggtgtggtggcatgcacttgtagtcccagctactcaggaggctgaggcagaagaatcgcttgaacccaggacagaggttgcagtgagccgagatcattccactgtactccagcctggattacagagtgagactccatctccaaaaaaaaaggctccatttgattgaactcaggatagctcatcttgcactttcacactttcacggactagacattgacttgtagtgtgttgtggttgttgcggaggaaatggagacattccttctgaacttagagctaggaacaataacggcttggaaagagcattcatatttgttaaaatgcactccttagctacaatctcatactgtttcctagaaagaaatatcttgcatactgtcaaacctcccacaaagattttcacatgtctccaaagcttaacaaataaatatcattgtcttatttgacatgctgatcccacgtgttttctggccggtgaaaatatccaactaaggaaggctggagcattttagttcaaagatgtttgtcaaagccctcagtctctgtagagcaccttcaggggagagggaatcagccgagtgatgcccgtcgtcgtggatgtccagcactttacaattcagagaacaccttgcctccaatatctctgttgttttgcttcccttgaaaggtagaaaggtcatgtgaggtaacagtgggttgaacaatctattcatgggcatagacagagtaagaggcagcttttgccacaactcagctccaggactccgactctcatgatctgtccccactccaggctgctgtggctacagaaaaaaaaaaattcaaagtcctgtgcaactatctttgtttcctcagtgagccacagacagcaagcataaaagcatttttcatttgagcctgggccgcctagaatccctggatgtggactgcccaggtggggttctgggcacctgtgtgtatgtggctgacctggcccttggctgaccaatcgccatacagcagagctgggcctaagcagagcccggtggaccaggccaggaaaatgaagaggtggcttcggttttgtgtcagccactaactcactgcgtgaccttgaacaagcccctctctttctgtgtgtctccgtctccttatctgcaaaactaagggtttataatcaatcctggccaagcttctttcagctccgacaacccacagtactgggacctgatcccaggtcatgcttacccacagtgggagggaggttggccttccgggctctctaccatgtgcagattccgatcacaatacctgcctctcatcttctttcccatattccccccactctgctcatagcagagcctctctagtctttattttgatactttaggagcaagtaagagaaaaccggactcaaaccatttttaataaaaaaatgtaatgggtttgtgcatctgaaaagttcagcagctcaggggacacaaccaggaccctgtttctctcagtatctccaggttccacttgtttggtgtttgcgttcttctcaggatgagtctttcttcatggtttcaagatagcccctgcctcttgggaagacgtgcttccttgtttatcctcaaagatgggaggtgggggtgcagtgagaaagcatctccttgtactaccatccaacaaaaccctgggcttttggctgggcatggtagctcattcctgtaatcccaacactttggtaggctgaagcaggaggattgcttgggcccaggaggtcaaggttgcagtgagttgtgatcgcaccactgcactccatccagcttggtcaacagagcaagacttcgtcctgataaaaaattaacaaattaactgggtatggtgatgtatacctatagtcccagctactggggaggctgaggtgggaggatcgctggagcccaagaattcaaggttgtagtgagttaggatcatgccgctgcactccagcctgaacaacagagtgagaccctgtctctacaacaaacaaacaaaaccctgggctctcacctaactggttccatgtatgacacatgctcagtcctgagcctgaagaataactgtactaattagtttaggcctaaaccctgtgccctcccctagaaccagaggtgagcctgcctcactgaaacacaagctccactaaggaaggggttcagctaaacaactggggtgcaggtgccatcagaaaagaatgggtattgggtggttctgatcaccagacgggccttacaatggccctttgttggtatattggtaccaataccaattggtaccttgggtggtatattagtttctgatggcttctgttgaaagaaattaccataaccttggtggcttaaaaaaaacacaaattaattctcttacagttctggaagccagaggtccaaaatcactttcacagggttgaaaccaaggtgttggcagggctgtgctcccccgcggaggctctaggagcgaagctgtgtcctggccttttccagatcctagggctgtgtccctcggctcatggccccttccttcatcgtcaaagccagcagtgtggcaccttccaatctctctctgcttctgtggtcacgtcatcttctctctctctctctcctcggaccctcctgctgccctctaatgaggcccttgtgtccacattgagcccaaaggcaatccaggatcacctcccatctcccattcaagatcatctcccatctcccattcaagatcctgaactctatcccatctgtgaagtttcttttgccatatgacattcacaggttccaggaattaggacctggacgtctttgggggacattgttccatcaaccacaggtggctctcctgctgccatgggcataattacgtgtaccttcttggtgcttcccaggcctttcttcatacctgtgcaatggcacttatcacatttacatcctggaatcctgtatgtatttacaggtctgcccactgggctgtgagtgccttggtactatgaactttctatttatttccccagtaagcatagcagcatggctggctcagagcaagttctcaatgagtgaatagataaatctcttcacccaagcaatgtaatgcaaattgaaagcacaagacccaaaggaacctgggaccaaggacaactcagaggcagcaaggggttaacgcaaagaccctaaatcccagtctcaaatctccaggccccttctgctgcctccatactgagagagttagccaagcacatcttatttcctggaacctatttttaaaatccctaagtactagtgagcaacattgtagctataaatagaagccatggatttcatgatcagggaaaatgagtccatcatattatttaaaaaatacccaaacacgctcactatttatagcccaaggatttccacagctgagcatactcactgagaacccctggctgattttccttccagccaaacagggcttgtggaaatgtagcaggcagggggaaagtatgtcatcctaaattgcatttatttttgaaaacccactttctaaagagaaggggatcatggaaaatgtatgaaactgacaggagtcttttaggaaaaaaagaatcacattgctggtcgtggggtagctcagggttcggagagtgagggtgaaggatccacgcaaagacgttcattgggaaacgtaccaccaggccagaatattcaggacccagtgagtccctctgaaatggaagtaatagccagtcttcactgagctcttactgtatgccaagctctgtgctagggacctgcatgtattatttcctttcaccatttcaacagacacaatatgctagtcctattattattaatcccttattgcatgtgggtaaaccaaggcatagagaggatgagcatgtgggattggagagggagccagcattctgaagcacaagcctaggctgtcagcatcatggtttcagagagcagggagaaggtgggtggagacctgtctgcacatgttttccgtttggtgtgcaagacctccatcatcaacctctatctgactcctgggacaccccttccttctctttccaactccttctccttcctctcctcccactcagcaaatgcatcctagagagggaggtcattgccttactggcttaggctcaggatgatgtttatcatatttaccctccagcctgggaggctatggccaatcaggacagctgttgaccataaacagccagggccaccatacagtcctgttctgcacccaggaaggtttcctttcttccagctagatgccctccttatttctgtaccccgtccaggcccactacttcctaagatggcttccctaattacccctgccattgccgcttttcctcaactggcctctgtcttcctagaggaccgtatctattaaaatcacccaagttgcaagaccctaaatgtccttggaaaaagcagatgctgcaaatatcaggtgtcagctcccaggaagcaggcacagacagtcacagagctgaggccagaggaacatgagctcaagtctcagactggctgatgaagaaactgaggcccaactcaagggaacgtccgtccctggccactggtggaaccaatgcagggttcagttttcccaagagtgagcatcaaatgtcatgtaggagaattctgagcacggtaatgcctgtgggcaagacatatcatctgtcaactttctcttttggaaaatgagtatctaaaataagattttgtaattacttctcagtaagatcttctttatctcctctaccacgctcttgtccaggtcaacatgagatctcccctgacagcagcaacaccctcccacttggttgccttttctttgctctgtcctttctcattgtcattcattcttcacgcttcaaccagcaaggtcttccagaaactcaaattgggtgatgtcatccctgcctcctctctatgatgtcatccctgccccgtcccattcctccaggtaaatcataaacttcctatgaccgttcttaaggcctttcatggtgtataaggccctctccatttctctagtctttcctgttgttgctacacaggaggcttttgctccagccagagcaagtcacttgctgtcccctgaacccatctgctcttttgtggccctggagtctttgctcaagctcacaggagttctgtggaaacagagactgtgtttttcatctccatatttcttggtttgtggggatgctcaacacctgttaatggaataaatggatggatgggaggatgaatgagtaaacgaatgtatgaatactattttccacctctggaatccacctgttttccaagactccttcagtgcttcctcaccttcaacctcacctctattgtaaagtctctcctggacatcacctccagtatacgtctggtacaatttcattaagcctttcctgatcccagtgactgcagcccagtatatattttctgtatctgccttccccactagactgttccacccaagaacagagacacttttttgaatatgggttgattcccggtgcctggcatgagctttaatgactgaatgcactgaaaagctgtctggccatatgcatgaatgaaaaagctcagtgacacatgcccatggtcatacagagagctaggggaagagctagggccagatcccagtgatcaggcttccagttctctgttctttccaacatgtcccagtgtatataagaagctggagatttcactagttttaggattttttccaggtctttggaatgccacaaaacacaccaagcaagtaggagtcatctcaaagtgaccaaaccagaatatgtctgcccatgatgccaaactcaatcactcatcagtggcttcttttctggaagaatggtatccagggcattgctagtttcaccttgtatcctgaatgactggattacaaaacaagtgatgatgccttcggaggaaggtgttgacagcaggaagatgggaacagatttcagagctgggagtggtttagagtagcaataagagcctcagacaagaacctgcattattttttcaactctgttactgatttgcgggtctgtctgggccttggctcacatttccacaatatgatgaaagtagaatgcattttctctaaggcccttccaagttctcaagctctgtgtgtttatatctccaaagctcattggaaaagatgcaaatgatttgaaggctaataatgaagacagaaattttccagtaatgtgacaagtagtaggcttattttccaagtgttcaacaatcaacaacaaatgtaacaaaaataaagataaaatttggaatgtttcttaaaaacaaacctactagattcaatgtgaaatttaatcacttacaagtaatatcctaaccgtgatccatccccattacctggaagacctttgtttctgctgattcccatgccttcttctaatagaaatgcccttacaactattgtttgcagtggggtggggagaaaggaaagaaggaaggaaagagggaggaagagagggaggaaaagggggagggagggcagaagaaaccccttaaaagattacaaagtacttttatgtagattaatttaatctgtcataagaagcctctgaagcaactccatgattcccattttacagataaaagaacaggggcatagataaatctcttgctaaggtcacactattagtaaaagcagaaatatcaatcatggtcatcttgaatttccattctatggagctgacaataggataggaaagagaagatcaaaaaccagtattagccacataagggccatcatcccccaccaaaacaaagtgatgttgaacctgccttatcagataacagtcatcaatgtaggtcagtaatttcatgtgactgagtcaccatgacaaaagctaacaatggctctcagattttgaaagatgtggctttgtttaaagtattcaaaagagatttcccacactgaaattcctacattaaaattttaattaaatgctacatagcataataaaatagctacccattttgtccattcctttgtcatatttcatcttcactgctgccattttaaagattttcagttttctctatgagttacaccaatttctaattggcatcattttgaagttgtacaacttctggtgtttcaaaggaaatcaaaaaagaaggaaaagagagccacaagatgtgattgatggagaaggtaaactcagcccttccacaacatgcataactgctcagtttgagtgacttggctttgagaggcattcattgcaaaggaaggaacatttgttgtgaatctagtgtttggcatggggaagggacagatgaaaagatgaatagactttgaggagttcaaaatctgctgacaaagatggacccaaccccacttagtgagttctataacagtcctctcccagcttcttgtactgaagtaccatttttaaccatctttgcagccatctcttttgtgggtgtgtcaaatgaaaaaggtgcatctgctcccaggtctgttaataatacatttcacagcaacaatactattattgctaacaaggacgattaacatttgtatcatgctttaatgcttacaaaccacagtcacactcaatgtgccttaaaactgcagaattagagaagtttgagtcaggtaatatttttccactgaaaatatttatgttcaattttctacaactagcaaattagagacattattaacgttttacaaatattgtaaagagaaccccttgcaggccatttccaactatgccaaaatgcatgctgacatccttcaaatattaaaaagagcaagcaaaacatttcaactatttggactatgtgaaccaagccagtggggaatgcacatgactctgcagaagcaaagaacattattcagcaaaaaagacatgcattctgcataaggctataaaataattttttcctagagcatatttttagatcattgtactgcaagaattctgatttctttctaaaacaaattgattatcaagaatcactgaacttctgtaaaagaatagcaacttatctaaatttcctgttttgacaagcattaaggaaaattatgtagtactcacagccacaagaggaatgtgctatagagttcttatactgttgagactgttaatcatatcaaaacaaataatttcactcagctaagtttgtacttggtagagcagatattcttattgcaatacttaattcatggactcaagccattggccattcaaggctaagggcatagaggagccggcacatgcaagtctctctccatggtactgagttgcccatcctctcgcgttagggtctagttgtgtctctttcctgctgagaggaccagatgcagagtcaggatttagaactctgttccagctccatcactacataactaattgtgtagccaaggtcacattattcacttgttttctctcatcctcaatttcttcagaatgtaaaattagcacattaaaaagaggactctatgctccaacaccctatgatttggtgacttaaaattgccaaagtagggtgggcatggtggctcatgcctgtaatcctagcactttgggaggccgtggcaggcggattgcttaagccaggagtttgagaccagcctgggcaatatggcaaaacccagtttccaaaaaaaaaaatgcaaaaattagctaggtatggtggtgtgctcctgtggtctcagctactgagaaggctgtggagggaggatcacctgaggcccaggtaggttgaggctgcggtgagccatgattgtgccactgcactccagcctgggtgacacagtgaaaccctgtctccaacaacaacaacaaaaaaagatattgctaaaatatttgaacagctggcagggttctcaatttgatttaacgaagtataattagggtcatctctcatatttcatatactatgctaggtactaaaagtacgattacatattagttagaaactttttggttgaaatggacacaaaacatactggcttatatggaaaaaaaaaggtaataacgtcgggtaatttactaggtcaagaaccaaacttgtaggattccagctgggagtcaggttcaattggaaagagaacctgcaacaccctcaaatctttattttttctactttattcctttattccaaaatgacttttacccagaaggtgtgtggcagacagagtttcaggtgccccccaattatcccagcctcttagcactcacaaccttatacaattccctatccttaagtatgggcatgacttgagagttacctctcaccaataaatatggcaaaggtaaaatgacgtcacttctgtgattacgttacctaagactgtaacatgtttcttgctaacgtgttttttcttgctggcttggatgaagccagtgggcctgttggggaggccccagtgacaaggaactaggggcagcagcctctagccaacagtcatgtaggaactgaaggtagcctctggccaacaccagccaacaacaaactcagaccttcgggcccatgggcaacagcatccggttctgtcaacagccgtgtgaacttggaaagggatccttccccagctgagccttgagatgagacaggggcatcagttcccaccttgattacagctttcataagaggccctgctgcagaggatccagcaaagctgtactcagatttgtgacccacagaaactgtgagatagcaaatgtatgttttttaagccactgagtttgtggtaatttgttatataatagataaataacatgaagggcatggccactaaaatccctgcacctgaatctcaagctttggaacctgggcagagctgaaaacaagtttttctcctttcctgttgaaaattcctaatgaagagctttgatcatcccagcttgtgtcaggtatccacactactaaccactgaggccagggaggtggaaattggcaggaggcagcagcctttattcaggctgattgaattggatagaacatttcccatgacaagagaaaaagtgcaattatggtcaggccaaacagtagttgcccaccgcaaatggtgaacaatgtacattttctttgcccatgatctagaggcaggtgtaagtgagttaattgcctattaaaatcagttgtttctctgctgcagtaagggaagtacagatcttgaagaaggacttttacacaaacctgagagtcaggaaaaaatatccagggaaagtgacacttaagatagcaactgaaaactgagtaggagtaatccaggtaaaaaaaggacaactaagaatgcctcagacctggaagacatcttgtgaaaaacgcccaggcactagagaagaaaaatgaagtatctggttgattccaaacatctttaatatactcagatcacagtgtggagagtatgctagggaagtgccaagaaagaggctgaagaaattttccagggctgggacatgaaagacctggtattagtcagaattcctggtgacatatcatagactccattcttagttggctcgcagggttaagacaccatgcagtcagaaactctgcagccatggtgagacccagtacaccagaacatcgtggttgcccatccccaccattggcaccagtcatcccacactggataacaaaagctctcccagagaagttagatgtcccacccttctgcctggtaggagactatctcccagctcaccactgggtctgctgcctcaggtaacactttggcatccagctctcacagtgggggtctgattggaagaagccaggtcgcttgcctgcgtccgagctgcgaggaaggctggaacgtgttattgcagatgctgattttattccatcatgggaatgtgggaatcatatatgggaactgtcaaagtgtagagaggttgctcaaaagataaagacatccataaatgacagctgctcatgaaacgcttcatgagccaaccaagaattttgcctttgtctcggaggatgtcatcaaaggggtttgggtaagggaatggcatgcttcctcttatagtttaggaagctcacttggcatagagggtggaggatgaattggaggcaaggaggccaggtggaaacctgttgaggcattcaggtgaggaaacccaaatgctgggaataaagttgaggcaatgggaatggagagaaggaaaccgctgggtggatcctaggaggcacataaataagtactttctcttaagtagacaaaaatacttaataaattaccattcttttctgcacacccgccccccacccccccccccacccgcatcttagcaacacttggggatattcctctctacctagggttaaatttggatttttaaatgcattttcccaaagaaataatacagtggtgggccatgtgggaaacctatcatttgtaatatagcttctctgacaagtgtcttttaaatatatattgagcatggaatctttcttcaaatgaaatctaatataaagtcaatgagggcagatgttgggtaagcgtggtgtttttcagttcagaactctgccctctctttctttccaaaatatcagcctggaggaagatctgcagaaccctggggtatcatgttgcatggtttgagaatatgtgccccttgaaagtgtgtcttgagcttacacaaaaagcagaactgactctcagttgctcttatgtgctgctgtaagtactaggtggattcactggggagagagaggaaaaggaaggcaggagctaccatagaaagtttcttggaggaaggtggctagtgctgagcctccaaggataagaaagatgtgccaaggagggagtagcaataggagtgctctatgaagagctgatgatggcaagggcacttactgaaattagatgagtggtatggtgggcaggctgtaagatgtccccactggtccttgtctcctgggattcacacccttgtataatcccttcttcttgaatgtgagcaagacctgcttttaatagaatacagcaatggtaatgggaggtcacctctgtcattaggttacatgagatcttggtttccgtctttcttgcagctctcttttttgtcttcttgtcttgcacactttgatgaagcaagctgcaatactggagaggctcatgtggcaaagaattgctggtggccactggccaacagtcatctaggaagtgaggccctcagtccagcaccctcaaggagctaaattgtgtcaacaatatcctgagaagaggcctgcagtggatacatcccctgttgagccttcagatgagctcccagccctggttgacacactgatttcagccttgagagagaccctgagcagaaagctcaactgagctgtgcccatctaactgtgaggtcataagtgtgtgttgttttaagtcactaagtgttgtgaatgtgttacacagcaaaagagagctgatgtagtgactttgggcatgctcttcatattcctaaccctcagctttctactctgtaagtgtggggaatatgtggaccacctttcaggtttggtggagggattatataaaacaagacaaggaatgccagcattctgtagggctagctgtagatgttcaataagcagtagctacagccaccactaccactaacatcaaccatgcataaaggagaaataaccctcagaagattttcacaatctgtgcatgtctgtcacttactggaaaaaccaatacggccccgtgaacctctcccagaaatctagctctggaataagagtgaaagacatacaaaatatctctagaagctttaaacccctcagttttgagggttggccctaaccatgcatgcttcttgatcacactgcaccaaggaaatcccaggttcagtaccatgtctggatctgtaatatacattcatgagctgatcttatgtcaggggagagaagggcaacattgtgctagttttttaaggcagcattcccaagttaatgaaaaaaagtctgcattttctttatcattcctccatcatgttcaacctccaacaaagattacaaccttcagatattagtcactctccagttgtaagagttaaggttaacagggtaaacagatattcagtactgctttgccagaaaaacttggctgatccaacagattttaactccgtaggacacattttgctgtatttgtgctttcctttttttgttctgtcttccctagagaagtattaactcaaagtcatcacgagagacccatcgctgcttcctgctttttatattatcacttgcatctttctcttttataatttctccagccatttgattaagcacacacacacatgcacacacacacacccagaggatgccatccacttctaaaaaggcaacaatttgattggaaaatggagagtgtataaaagcatcttcatatccacccatttcactttcatctacctttcctggtctactcaagccaacagcaggactttgctctttaaatgtaatggctgcgatgaaatgcagttagcgaccgaacttagaaaggaattaagaagactgaagtgggttggaagctaacagagaggtaccctctggacttgtattttcagtgatctctaaaaatgtgatggattccaatgatgttttgacaaggttgctgatacttaaatcttaactgtttagaaaaaaacaggtaagagatgaaagaacatatttttctttgtccaaagtaggtacggtgactgtgttttgagagggtgaactccgaaaataacagtaatttgacacaccagccattaagaaggcaaagaggtaagtctgtcagccactgcttgttttgttagtctgaaaagtgagaaactatttcttgaaagttctgcatttttgttcattgatgtgacagaaggtgttgcattttattagcaatagcctttgcctagtcatatatacatatatcttactgttagcttttaattaatggcttctaacaattggaaatattcattagctaagtttggatctttgaagatgaaaaaatagcctttttcagtcactgctttttcatctgaaaaatgggaatcatgatgtgagcttgtggtggtagtatgaattttaagtagaaataatatacatgaaagggcctggcacagaatagaggctcaattaatgctggcgaggatgatgatgatgatgaaactaagcagagatgtataatacactgattattcctatggaaagcataagctttctttaatcaatgaaatggctttagacattttcctagatggattattaatatggtcaccctagcaattcaacattcctgtgtttcatgaggtatttgtaagtcatccaaagcccctccttccttattcatttagaggaatctagtgcaaggaactccagctggatttggcttcatgcagagcttcagacaggccaagttggcctacggctggtttgtgagaataaatagaactcttaggaaggatctagattggaaagacaagatgaggagctctttgccttcctcattgtccattaagaggctctccttcagcgtgacggaggcaatcatatgacggtttgctccaaacttagcagatgatgtggttaactgggtgggtggggagcggggtgcgtggttcgagaaatggtctctgatcctagttcagctctgtggcatgtcatctcttaattaccgtggcttccctgtcactggagaatatttgtcagcttttagaacaattaatattatggagagttgagactaagaggaagaacaagggacttcaacaacctttacatttttagtaattttatggatatgtttattttatggacaatctccccagcagaactgaattactacattaatatttatccttggaataaggtaatgtgtgctcgagtgtacacggagcaattaatttaacaatgctctccaatcttaccttgggagctgaaaccaagcatgctgacattgactaattataaataaaatatataggaatccttttgtttgtaattaactggggacaaggctattactaccttgcccctgcattgtaagttatcataaagaaaaaaaaacaagaaccacctctcatttagggattcaacactgtccaaagtatggctgggggagataaataaaacaaggctaaggtttgtgtgtcctgtggcctggtgtggaggtgaaaggggaaggttgggctagagaggagacctcagcactgagattagacaatctacgtcacaggcaaaaatgggaatagaagatgaaggggcattgggctgagggtatccctgtgaaggcatgaaacatctgtggcatttttatgtgatgcttctttcatgtctcaccaggtggacacccccgacactttctgtggtcttttaaaattctaaataaacacagccaggacaccaagacttctcctagctggagagcaagcatgagtttggttcaaataggttttgagcatgattaagtgactgagagtggatgtgttaaggcctgaataatatctgaatgcttctcaggtgaaaacctcttagaggtatctgtagcacagctggggaatcctgccaatggcaaccaaccaccttgattatctactatcacctgcaaacaaaaacagcagcaagaaaaatgtaaaatggaaaaatgtaaaatgagtttgttgctgctgtcttactttgatgggagaaaggaatgaaaactcaaagcaatgagggctttagaaaaatcagtgcctggaattcaccgtggtgtggactggatcgagccatttagaatgagggaagcagtctttgcacaaagacagtagaaacaggaattaatcaatttggcctttgctgatgctattcataaggggacattattcgtttctggttgggaaatctttgcttcagcacgcaggctgtagattatgcaaaagaacattttcttttgtttccaacacatcacggtgtttgcaagacagtctgagatgggaaaatggaacctgttcgtattcaatctggttgagaaaaagataatgaaacggccacaggcttttttttttctaagagatgatttttatttatttatttttgtgtgtgtgatcctacttggaaagaaagcaaatttcagttaataacattgagcagtattgttgctttgctagatagttacaccaccggctgagtatatccctccttgcctttggaatctaccaggtcctcatcacattctggccaagctaggtggggccgaggtgaccagctcctcaagggcaggtgatttgtccagctcaaggtctggcagcgagtttgctgaatgatgtccccagatacaccaacagaagcccaacaaaactaatttcgctgataccatagctaatccctttcaaacacatagtactgtgtgagccacatgggtataatggtggcccagaaatgatccacgcagttattcattaatgagcttattcatcaatgagtgccactttcccagtgggagaggctagggtgtaaaaagatttccaacatgttcacccttgagattgcctgaatttgtacctcatctatcttgtcatattaaacaggcagagaaagccactgctcactttgatgggcattggatactggcatgaaaagctatagtcctgaaagcctgctgaggctgctccaccgattattcatttatagttgtcactattgtaacaggtagacagcaaagaaatttgaataattgtcattaactgttggactcttacaatctcaaagggaccttacaggttactcagacccttttcaacatcactgcttaacaagccttcagcttttgcttgaatgccgcgagtgacggggaactcactacttaccaagagagcccatttgttatttgggttgctgtgagtcacgagttggaaaattgtttctgtaaagggctggacactaaatgctttaggcttagtgggccattcggtctctgtagcaagtactcatctctgttcttgcagcacagacaagacaaaaacgaatgggtgggcactagaatcttgtttaccgaagtggtcagtgacttagatttgacccatgagctgtggtttgctgcccactgctctaagggtgaaggtgctctttctcatcttgaaaaaaagcaattgtcttcctggtggcctagttcaacctcttggggccacctgtaagagctaatcaagctctcgcctataagaaaaccctgcagctatttgaaattgatggtatcctctttccaaattatctcttttgtgtttgccacttctctccgctcttcccagctgccccaatttcaatctttcaccacctccttggtgtggtcagttggggatctcattttgataacctcttgatatgggtgttgcacagcaagatttccgacctgaaagctgatcctaaacaaatgtttgagtgctcttgacttcatttcacctgtgctttatgtcactcttcagtcaggccctgccactgacgcaggctgtcctatttgagtgaatgcatatgagtcaaactgctgctcagcccagaggctgcagtctgtctggataagcccagccagtcacccttctggcttcctgctaaccagggagctctgctggatagacgctgcccctccctgggctaccattttcttcctttgaagctggagatgctgacagagtcaagtgagctcagggagatggacatgcattgtgaactgtaaagagccatatgcaagtattaaaaattaacaggaccaggctgggggcggtggctcatgcctgtaatcccaacactttgggaggccgaggtgggcagatcacgaggtcgggagattgagaccgtcctggctaacgcggtgaaaccccgtctctactaaaaatacaaaaaattagccgggcgtggtggcgggcgcctgtagtcccagctactcgggagctgaggcaggagaatggcgtgaacctgggaggcggagcttgcagtgagccgagatcatgccactgcactccagcctaggtgacagagcgagactccatctcaaaaaaaaaaaaaaaaaaaaaattagcaggaccagaccacccaggaggaagtcccaggttcaagtcacagggtccgtcaggtatcagcttggagactgaggaatcctccagatcaaacccccatgtacatgataagagccaatgaaatgtgggaaatgagacgttttgaaaacctcagagcactgtaaaaaaataaaaagtcattaacagtagagatactaatttttagaaaggaaggatgcttccaatctttcctgagccatttctaaggaagtcctttctctctcttgggtcctactacccccaacccaatatcatacacctgtctgactgcacttcacacagtgtttcttctctaaaaggaacaattaggtttgacctttctcagtgggctctaatttttcagtattcgaaagtctttgcaagtgctgctcctggacttgaaatatttctgctccccaacccccaaaccatttccctttcatttgattgactcccacttatctttcagactcattttagaagtccccctcaccccaggaaggcttcctcaatctcctagatccaaggaagggcctctcttttgtgcaaccacatgacctaataagtgctcaattaacacttattaaatgaatgactgcacaaatgaatgaatagattgtggatgcaataggccaatatctgcaaaaagctggaaacagatgtactatttatgtgtctcatgcaaacattacactcactaccgattgccaagccctctcacacagagggactggtgaagtatactgtgtgccttgccacgtccctgcaaagtgtggaggctggtagggatcaggaccccaccgtccttatgaatgatgggaggagactcagtcaagcacagccactaagtcttggcttgggtagctgtctggaggctggatcctcttacagctacctgctccactgtctcacactcaccaccccataggccagactcagcagatggccttgcctgcttcttcagggaggaaaccagcactaacaggaggcatgggctcccctagctccctctctacttgcctccctgagagctcaaaagaagggcagtccctgcacttttgagacttttcttccacctgtgtctttcagcatccctaggacttgctccatgtcttcaacttcttgtctacctgccttgggtctctctcagctcctgcacacaagagctgcttgttaccagctctgggatttcccctgcgtattcctcctgattagcttgttcttgcttctgccttatcacctggccaatatttacggatccttggggacccaattcagatgccacctcctctgggcagccagctgcagtccctgcagataggtatagtcactttcctctatgcctccaagaatagtatttggtaacctctataagatagggcataaaaattcacacaacaactatgagggtctagcgatgataataactatctttttatcaatagctcactctgttccaggaactatgctggagactccacgcacacatctcattggcagtcctaagtctcaagcagccactacctatgttactattgttctttttttcctttagcctggcagacagtataggaagttaggaacttgggcttggggttaggaagactgggttacaaatccccaagtccatcatttgccagcttcatgactttagggaacttacataacctttttgagcttcccttcccaagcaaagataatggacccactttacagggtttggtgaggttaaaatgagctttcctagataaaactcttggtacctggagttcctggcatgggttaagccctcagtaaaagcccctatgaggacccagaagacagaggacttatgtaagtcatttttgcatccctggtgcctaacactgtgcctgacttcagtagatactccttacaaatttagggtgatgttcttccactgcattgctgaggaacaatccctgtgtggccacagggatcatgggcttcctcaatcctggctttcctgtgcactccccacttcctattatttgagaaaaacatgaagaatgaatatgcaatgtaggagtcttccctgctgcctttttccccatgcatacacacaccaataaaagatgtatgtgccagcttttgctatgcttaaacaacatttttcaaatctctgcaaaccatgaatgagacacttgtgccgtcaaatcgcacttccttacaggctgctttgtttcctggaatagtgggacgcatggaatccaagctctgaggtttcatttattgtaagcactgggctccctgaccaaattaggtgtcaaactctacctgcagattgggaaattggggctgaagaaagagccggcagccaatttggcacacagaaatagttcttctggagtttctggggaccacctccctgtctgcaactacccataataactggttgggaaattcagagatattgctcccaatttcgccggaaaatgttggaatgcaactgttatacacaggctgggatgcaaagtgcttttctcagaaaagtgtggcctttggaccctggtttcttaagacacaggtttctgtttccatggacttgcagggtttttcaataggagttactggcatctcaataataataataattggaggaaatgtcttgtcactaagccaacaaaaaccactcagactctgctgtttcccaaagcccctcatggagggactctgtcctgtagagctgcagggctggggtgtgggtgttcctgggcaggcctgattcccctaaatctctgctgagtctctcctctgcatctttctccccacatccataccatgaggaagacagaaaggccagctagggagggtatgggttggtgttgtggacgaggtggtaggtgattcctattctgtagcagggatgggagggaagcagccttttggtaggcaggaggatcttctgagaagtaggggcagaaggttccttgcaccatccaactggggaaggggcacagcggtgggccctgggaacctgctaaccaggatgtctgggttcttcccccagctctgcttctgaggcacccagcagacctgggcaatttgcctcctcgtcgatagagaccatggtcgctgcttgctctgaccatgtttcccggcacttgccttacttccctggacgttggggtggattttggtgaggtcccagagaaccaggagacaggctgcttatcttctagaaaatcatgttcacattcatggaaggccttaggtactagtacttagctatgacctttggagacaaggactccatcttcctgaagacgttaaaatgtcctgtgtactgaaagcaattggaggggcctggatttgaaccccagtctgtgtcagaggtcccaagtcttccaagaaagtggaaggcgccccgaggcaggttagagggcctacaaggcgggcaactggacatggggatgggctggggaggcgccaaagggcggcagggattgggggtatagtggtttgaccacgacttaactaccttcagctgccaggccatccgcctgttccctggaagatataaggagctgggagtggggaacggagcaacctgggcttccatgatgaagaaagagacagcgcaggagcaaaatgtccaggaaggagggagagagaccagaggaaggaggaggcgcctctttcacccgcgtccccaggtccccatgtacgccacgtgggtgggagcgtgtcccacacacccgcgcgcccaaagccacattcgccacgctcccgccggggcgggctcaccgcgcgcctctgggtgccgagcctccacaggccacatagccgccacctgctgctgcatccccactgcggggacaggggcactcagtgcctccctccgtcccccccgccccgcgaaggcctcccatcctccagggccaggcggaggccacgtctttcccgggccccctccccaacgcggagagggaagcggagggaggagcttggcccgcagccgccggccctccccgcactggagctccccctcccctccctccccgcccctcggctgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccgcctcagggcccctgtcctaccctccttccccacttacagcctggaaacattcggggcttccgattgaatcgttcaatttcccctgccccgaagccccgcctggaggctgaactgcccgggcagacctggtgctttcttctgccttctggagaaagatgtgggtttgacatgcaggcgggagacctgtctggtctagataacggcatgtgtatgcagctaggttcagacttagcatttgggggcaacaactcttatttagtgggtgtccaggccgtgccgggcagtgtgcctcaaagccgctctgggaaataggtccccgtttctccttggcccagatgaggaaactgaggcttagagaggttgaatgacttaatcaaggtcacaaggttaggaagtgggagaccaggattggaaaccagggtaccctacttccctgccagactgttccctttgtaacaaacacacctgtctcatttcttctactaactgcttccgtctcgagagtcattgcgtgtgtgtgaaaatacttgctccaatgagtatctgttctgatgaaataaattgcctgtagcaagcactttttgtccatcctgccatcacgctgctgccaacccctaatgtgtactctactttttagttcaggtgagaggataatatgttttcctaggtgttctctttcctggggttctgttttcccagtcctcctgaaggatggaaaggacagtggttcctcctgtgtgcccagcacatgctaggcctcagaactgcatccttaacctttccctgggggcagggctcatcaaggttacctgcccctggttttgtaaatcttggagatgattacttaaccggagcgggggctgatcccagatggccactgtgcaggggctggcccagtgttggctcatatttgccagccctcagtgtcagcagaacttctgagccccaaacacttctgagccccaaagaaaaggagttttaatgcagatacgatgcctgatgcatgcccccagttctctggcttgccgctgttagctgtttgcttaagtgcatttagttaactgtttgcttaagtgcatttagttaactgtttgcttaagtgcatttagttcctgaaggggcaagccacctggaatcaattgatcctggtctgaggggcttgttccattggtgaagtcacagtgttgagctcagttgtctacacgtacatttgtgttggtgcagagaaagtcccttagcagtaggggcctctgtgtctctgttagtaaagagcaagggtggactgaccagcccttcagacccccttcagctaaatgattctgagtgacaaaactagtaagttacaggcttgagctaggatgtcttagtccagtcatttggacgaacattctacactgaatgggttgttgatttccaagaagaggacttggtttccagggagctgtgagattcaggttcagcccaaaagaggtgaagctcgagctgtgcttaatagattatttactgggctaacacatagtggctataaaatgttccaagctaccagattggggttgtgggataggttaggcctttcagtaggagagatgacattagctcctaagaactgatgacatacaatgcattaagaagatgcccagcaggctagaaagcagcaagctggtgagcttttcctgcccctccaaaaataatcaatcatatttgcataggtaaaacattcccagcacaaacaattactgcaaataaataaagtgattttttttttagactcttccaactgcattgtttgctgagtatattagcgatgcgtggagccggccttagcttggctgcagaggggctgggacagggaaggtgggctgaaggatgttcagaccctgagttagtttttggctgtggattagagctaaatccatcactttgacctatgggtcgttaatggggttgtcattggtctttttaagatgtggattaatgaacctcttaaagtgttgccgaatcccaaatgaaacgggcatgtcccacctttttcccagaaactcggctctcagcgggttttgtgactgtttgaaattcacaaaaccagagcaaagctttcatttttgacaggctcatagggatctgcaaaggaaaaataatgcatcttatgtagggatattaatctcccagcattgtgtgttttagcttctcatgattaactggtaaggttttgaataaaaatgaatgcagagaaacaatcttcattaagttgcttttgaaaatgctgaggtaattatgaaataacgatttttgtgtcatagatcatactactcatagccaaagctggattacatcacaaaacattactcttgttactgatatttattttttaattcattagttttctcatattttttgccttttttctccccgtgtgaaaataagccatcgagaataaattcttccttttcagtttttctttgtcttaaatccagtttttttttttctgtaagatctctaagctgaactcttccacaccatacatataatggcctcatgttaaaatatgttttaagtgccttggatttcttttgggagaacaagagggttatgtatcgtaagtaaataacagtgatgagacatttcccttgtttgcttactcttctaagtcagggcttgagaccatgccctcatgattgcagctgccacacttagcatcatggggacacagcctgagtgctgtggcatttctgcatcagtgaggatgcacacctggactgatcggagtgtgaggaaaacaacagcttccgtaggccaggaaacctggggtttattcccgactcagttgttcattggctttgtggccttgggcaaattatttccatttgctgggtctgggtttacatatatgcaatgggtgtgtacgtttgcatgtatatgtgtgtgtattggtaccagatattgccctccaaactctaagtttgaagaatcctcaaaatttgggtatagctggttattaatacctccagaatgctctgtactttaaggttacataacgttccaattagacattcctataaacaataagaaattggtgattatagaaaatatgctgtttattaccctaagtggagactccgtaccctgagtgtgtgaaggaggatggagctttgatccatcctgattatgccggcttccctatcagagtccccttgcacggtagaggctcagcacaaatctgagagcactagaatgagccatgaccctctctaggatccatgtggcagaagatgcaagaactattatgtaatttgggtcaatggggtaagaagactatgacattctatctgtgtagctttagggttcaggggacttggagattccgcctcaatctcaggctgttcctggaaggtaaggaaggggaagtatgtaatttgaaaatggagagtactttagttagagccttgaactcagctgaagctgggaaatggtgaggaagaagcttgtcagtttggcagtggtattttttgccaggttttgtgtgtaggcttcccttgtaacatctaaggaagtgtgttgtctgaggtcaggctccctggtgaagctgcagtcattttcagatagagagggcatgagaaaggaaccaccagcccttaaacactttgtccttgcaactctgcaaagtagacattgtgaaccctgtgttctagatgaggaacccaggctcagagagctgaagtgtctttcttagtctctaataattatcgaatggcagaaccatgcaatgttttaaatggactctgctggggtttaaatcaacccgtgctggacctcatttccactgctactgcagtgtgtctgtctggcaaccaaattgtgtccttcctccccaatttctagataaccatggcactaaaaaaagcatgcagatgatttgacgtaagtagcatacggaggtgattttgctgtcaataaacctctaaattcaccaggatttttgttaatgcattagatttcttttaactacacgaggtcaaacatgtcgatttccaaaaagattcctaaataagccaagtgtaaccctaacagggttagtgctggtgattctttgggaaaagctaaaagaattctcctgggtcccacattcatccccctggggttctgtgggaggtgaacacaaactgatgtatgcgacgtcagtctgaggagttgtcgctaggctgctcctcctgaaaaagggacacaataaaagttatgtaacagctttcaaaagaactgtttctcctcctccaggatgcccatgagttaatcctcccccaaacaacagactagagaaggtattcagaggaacacatgtaagaccttcacggttcacctacagctcttaggagtttctgggactcgggaggaaatgtaggtctcaaggaacttttcacgttatcgagtagagatgccgtcgtagctgatgttggggacggccttcggaaggtcacccatgtgagtatagctgctgctgttcttcgctgtaagtgtgcagagctggccaagcatccaccattcccaggaccagagattccagagtcctgttggtaacactcaatttacaaagagcaaaggaaaatccctgaaatactctgtcaccccattgcgtggctttacattctgctaacgatactcaggctgggtttcttcaccagcagttgaaaatgcttctgtctctgacgctggccttgcctgtgtcatgtgagtgacgtcttcaccaacagacccctccttccgtctcccttggatcactgagctgcttatatgccaaaagcttcaagtttgttgataggtgatgagaaaaattagacagaatgagttagaaagcttgactatgcttcatctacaatctttaaaataccacatctcagcagtcagcacaagtttttgatttggtaaatgaggaataacattgcgtgtcctcggtgcggcccatggaatctgcatcttctgcccccagactttgagagaacaggtgccccagggcttcagctctgggctagatttctaacatgtgtagttactaaaaagtagaaaatgcaagagtagctttgcagagtcaccagagaggataagataagaagacagagaagttcatggcctctgatacgtgattactgcgaacacttattcagggcatggtagtagaaatgatttcacacccgtttccagcaacgagaagcacaaaataaattcactaagaaatttagctgtgtttcttgttgtttttgtatgtggcttatgacaagtgcagatggcacttcatgtagttaaaaaccttcgccttcctaagtccttcgtggtggctaagagaggctaggctaaatgccttggcagacctgcatttttgaaacctgactcccaaggtcaggtggtggtcttggtgagggtcagtgtatttccaggtgcttctgtttcttaataatctatgatgagctgctgtatgtacctcatttagcatcaccaagcaaaagagcaaacagagaatgcccagggcatttttcccaacctgccacatttctccgcctctatctgctaatatggtctggggatcctgatccacttcttgattcttttaattcagaaaatggatgataatgacagtcattttttaaatgatcaatattgataagtcttatatttttaaataaagtgaatgcccctgagagcatcacgtgcaagtttaaaatgatttatgaatggatacagtatcctttaacttgttcagagggctttattgaatacttctaaaacagtacgtctattatcctttaatttgttcagagggctttattgaatacttctaaaacagtacgtccagttttgcagtgttcaagtctaaaggtagacgtgaaaaccacatcctgtgttcttcatctgaaaaggaggagtggaaaaatacacccgacttctaaaagggaatgttgagactgttcctctctgttttactgacaagataacattgcttcggtctgaaaattctctgtagatgcatcttctacagcagggctggttgtcctccagtctgctcgaggacatccctgtggcggttgagagtggctctgtccatctgtgcaggcatggagctgtctcctccacagagcatgcctctctctggtcccgtctggttactaggatccacccccccaacacacaccatcatcctttcctcagacagatgtcagggacaacagtttaacaaacagttatggagcactagctctggtccaggcactgctaggcattgaggctgcagtggtggacacagacagctgtagtgtgtcataggctgctactgtttcagtaggcctggggcgtcaccctctgccctttttaaggggtctgttcagaatctggaggatttagctgttgcatacttggaggcacgctggggctggtggggagagcccaggctgggaggcagggggccttctctctcctctcacctgggtgcctagggccaagccacccccccgccgccactctgacccttcactggtttcaagtgcaaagattgggtcactgcaggttttttccaagtgtgatccagggaccacttccatggaaacaccaggtgagcttattaaaatgcatatgggtggaccttgctgcagacttgccaaattagaactcctggggatgggggtgcccagaatctatatttttaacatgcttccaggtcgctctcaccttgagcacagtggtgttcaagaagcactggttctcctgggtgtcgaatcagtaatgcccctccctgctctaaaggactcagaatgtggcactcacccccatgctggccactcttcccaccttcacccaccgccgtgctgtccaagccaatcgactctctcttcaccacgcttcccgctcctcctcctctgtgcactacagtttgtttcccgtatggtagccagagtgagccttttaaaggatctcatttctccttggctgggagagcttcagtgccccctgtgcccaatagtcagggaccttaaggtgaccctcagggccctgcacgatctggccctccatctcacctcctctcccaccacctgcccccttgcttccctcttcatgtcacagccctagaacccacccagctgccaggcattcactccaaggagccacaggacctggggactggcaaggcagggtgccagccctggtaggtggggcacaaccctgtgaagctctgttttctgtcttgccactatgctgaaaacccctgcagactgacactcttaaacccacttgggcaaatctgtttctgggcctgcccaccaccatagtaaaagtaaatttagaagcagctctttaagtctaggcaccgtgttacagggtgactcatcatgggactgcattgtcaaagtggctctagaactttttttcgaggaagtttctggatatagactgcaaccctcttgggctggactattaactcagccacttttgatcccagggccctgtcatccctccttgtcttctttccacaagtattcacaagacacctgctacgtccaaacactgcggtccccacaatctgtgtctgcgtggttgtatctccgactgccgctcttgcttacagatgaaacaatgtggtctggaaagtatttctctggcctttttttttttccctcctactgagaaatagttgctctggcctgtgtatcaacagcagccctcttggggcctaggttaagcaaactgcactcgaaaggatcaatcccttggcaagtaggagggaaagatggaccatgttgtgagattaacctccaaggcgagctgagtgcgtaactggaagatctgtggggtctctcagatgggatgcgtgctcagcgcatggggccagggcttggttttctgaaagccagcctgcccagcagtgcaaatgagtgaaaaaggccaggaaaacttcagatgcttttgggtctgacattgcagatgccttaccttgaatcgtaaggagggaagcattttcacgctcagcatcaatcttctttgggatgctttctctggacatattgaccaagccttcactgagaggccattagcaaagtggggtggaggatgaaagtagagatgttccctgccttttatggtttcagagacagttggggaaaacgtgttacgtaactacctgtagctaattagagtgactgacgtgctctgagaaggcagagataggaaagatgggtttggccgggggagggtggaggcgtttgacttgagccctgagagacgagaaggaatttcctgagcagagttgagcgggaaaggccttctaggtaggagggcaagtgtgagcagaagcacagaggcctgtttattggggagagggtactgtgttataggtctgtagagtcaggctgaggctgcaaggcagggacaaggctgggtcactcctgcttagatgggagtgggtcttgaatgctagattaaggagggttccatgtcttacaggtgacagggaactgtgggaggggtttgactcaggatttgcattaaaaagatagctggtagccctgttcatgaccccctgtaccctctatattataggatagtgaagatgtgtaaaacgttcaagaagaaatactgtgtgggaatgagcatggttgtcccgggtgtaacctcaggcaccatttctctgattgcagtgtctctgcttgtctgtatctgttgtctgatcctctgggccctgctgcccagaccccaactccaccagccctgctggggctcggaaggaaagcaaggtagccgctggcttcagcaattgctgcccagccatcgtggactctagccaacaggaaatggagcgggcagtgtcccagcctgattcaccgagccatgggtctccctgtgcctctgcaaatgcattcaggctgctcctggcctaaaaacaatgctcccagacctacatccacagctgagagaatccagggcacacatttgcccgccagcttccctgagcttcccccagcagtgggctcagtgggtaggagagggggacatggtctggaatcaaggcgtgtgccactcagtgaccatttgctttgaaatcaatgtgctcagcagggccagtgacttttgcagagctggctggacaaagggaacatgaagaagggaagagtgtctcagggtcacgggtggttatactacccttgaacttcaccttcctattgctaaggaagagagagagacagaaaagcatgttccacaagccagtgggcaaattcttagctgttttctgtggagtctgggcctggcagagagccctcttcacgactggctgactgccagatggtgccaagggcacggcatcccgggcagtcagcctcctagtgaagattgccatcctctggagggttccctgccccaggacatgggcctgggaagggaatgcaattccaccctccatgggtcccatttacaggtcaacaaattgaggccaagagaagagaagtggaattgtggccgagtagcacatgaaatcactctggagtcggtcatgatccctgaggccggccaatgcccagtgcccattgctggcagcagtccacctggaaatggacagtttgtcctcacactgccttgctacccaccaggcatggaggatgtggctttctccttgttcatctgtcttccctcttggaacccaggcccagagccagggggctgggcatgacccctagatgtctggccttttgtttgcttcttggtttctgaagcttgtgtggaagttgaatgcaagcagagaaaggaatttagtagcaagttatcagagcagattagaatggttgtcaggatctgggcatggaaatcgatggggctgagttctctctttggagctctagggctcctgaaacgcaccatcaggtcctgggaaagcctttcatcctggttctcagagcacctagtgcacacttacgtacatacataagtttaagccaaaccatctcatgagatcatcatcgctggctccatctctttctttcaactgtctcttccctggatcctcagtacctggggtgaaccttgcttggcacctggaagtcactcctggcctgttagtgactggatgggggatgcagtgtgcaaagggacttgtgcagcggtcagtctggctgagcttttggggcagcctggtgctcctgactgtttctcaccttatcaagtaggttctcctaaatgcataagaagctgatgacagctctgctggctgacttcaaaacagtcaaaccttcagtgctttatcaggcagatctgtaagtacagttcctgctcataaaatgcatccgtcacagccccgtgcaacataaaggaattgtttgcaaactttcccaggttattacccccaaacttagtaaatatatgtattggataaataatcttgggaggtccataaattattgcagtttcggacagtactaatctacctgctggcacatttcataggtttcaccaccttattgactcacattttaatgaaagaggagagcaaagctataaaaactatcctcatgggttggggacccgaccagatgatggatgacaaagcagtgtagaaaatgtatgagttctgtgtggttattcagggtaattattattaagacattttgagcatctgacctcagttccttttgttttcctgggcaaggacctactacctcccagattctgctgcacttggctggcggcactctgtgcctacaatctcaccattggaatggcagttcttcaacaggattttgatggctgtcacagtcactttgggggacatgcaccttttatttgaagctgttcttcgagtcagattgtgaggcactggacagacctggattgaaatctgagcttatcctctaattccctgtgtgattcttggacaatttgcttcagcctttatgagtcctgttttctcttctgagaaatgggcataataacaacaattaatggtaatcccagctttgattaatatttgctgggtgcttactggggtagggaccctgtgcaataagtcctttccgtggactctttcactgaatgtgtacaatagcttgataaaggagttaattttattattcccattttacagatgaaaatactaagccttcgagtatgtattggtgcatacaaaaacacctcagataatggttttgaacatgaataatcatttattttgctcagctaggtggccttgctgcgggcctcatgtgaggttgcagtcagactgtgactggggctggaatcatctgggaggcttcctcactcgcatgtctggcccctgagtgagaaggggtgcacagcctgagggtgggagtggggaggctggcacagctgagactctccatcgctctgtggacgctccgtgtggctgggtagccatactgcctacctgtagtctagggctccattgacccaagagagagcaagaggttgtagtgcgtgggggtgtctgtctctatcctctttggtgatcgagcctcagaagtcacatagtatcacttccggcatgtccttagaagcaagtctctaaggccagcccatattcgaggggatggggggggcagttagactccatcctttgatgggaggagtgccgaaggatgccagtacgtttgaagccaccacggagtgcttaggtgacttacacaaggtagaccgttgcaaggcagcagagtggggtgtcggatcccgagcatggccgtcacccctctgcagtgtaaagtgtgaagcactacgggccccgtgaaacgggacctctgtaagcatgtgagctgtttccccttcagatgtcctttctgaagaaggaagcagagctgtgtgcgagtccagctgctgcttctcagcttcaaagaggcctttataccaacccttggggcagaccacctcccctcccctcccctgctgtccctggcctcccttcccttcacctggagccacattctcactttcttgggtcctgggcaattctgttttcatgggcctcttccaccataaaaagaaaaattaaaaattatttcttaggactgagctgatataaagatgaacatattaatgttacatattaaaagattttcttctacccagaagttcattgttttccttctgattttaaattggaacatttctgtgggccctgggcaccgtgcctgctgcatgtgaaggagaagttggcttgcccttccacctccacccctcaccccctcctctccctccccctcctcctcctccgcctccactattcactcttctgccctggccaccacttagcaggctgctgtcctctcctaggctgtgaactttcaggttctctgcaccctgggcaagccccgtgactgggagctgactgctccccgtaactctggctttcctgtctcctggtccttcaccaagggtagacctccctcgtgaggaggaacttaagcagagactcatcttccctgtaagcccacggagccgtcacccctgtctggcttctggctggtctctcatagcagagtaccggaagggcctcccttcctgtgcacctgcaggggtggtggcagtgcagagatggctgctctcctggctcctgcgtctgacaccccagccagcccatccatccgtgaatcctccactcaaccatttaggaaacagctttttactggtgagcatttcacgaggcctacctagtctccttcctcatggaatttagagggacacaaagacaaaaaaaaaaaaaaaaaactgacaaatgattctaagcaatgggagatttttttccccaaggggtggggtctcactgtgttgcccaggctggaaggcagtggctattcacaggcgcagtcactgcacactacacccttgaattcctaggctcaagcacttctccttttttagcttcccagcaatgggagatttttttttataagaaattggcatttcatggaaatcgaagcaagaagtgtagtctggcttcgtgaaggagaaatgaagccatcagcgaccaggatgttttccttcctctctgtctggagccccaggtctcaccatcttgtaccctttgtctctaaccttcctctccaacttcaggtttttcttctcgtcctctgagcatatggccaaacaatggtcaccccagtatggcagccccaaccctacatttgtgtggcctcaaagctcactccatctccccggggcctaatttcccaggagagaagtagagtggcctggcttggtgaggagccctctgctctaaacagctgtggctgggaggtggtgtcacatggtagggaaagctgtccctcgaggctgtcactgagacaggctccccaggtagggtgtgcaagaggggagagagaaatagcacgttcactacacctttgcctcaaaaccaattctggtttagggtggtggttgccagccttttgatgtccacagaagaggatatttgtttagttgagaaattggtataagattgcccaattttaatctgccctctctcatcagcatgtgataaataatttagaaaacaggaagaccttaatattagaatcgtgaaagtattttaaatttgttcattaatcaaattaatcaaatgtaattaaattaatcagagtattcttggttttcccatttcacccctgacagctgagactttggtcacagagctgaacgggtctgtgggcttacaccgggacccacagcactcggagtcctcagaaatcattgttaacaacaataatacaacccagacagcagcagaaagaatcgacccgtgtctggagcctgctgaagttggggggcagggaagcgacatgatctagtctgtgatttagaaagatagcccttcggccacgtggaggtcgaactaacattcgcaaattagaaatctgtgttggcaaacacttttaattagagcaaatgtttggcatatgcagacacactcaaagtgactgatttctgaaagtgcatccccattcggaagctagagccaaggtcccacctgctcgggggttttccctggagcttgagaggaacctttcactcacccacctccgagtctgaagacacaggctgccagcggttgtgttcatgacgtcaactttgacggttgattccttttttggagaaaaccactggcttttggaataattttcgccctctctccacaagagccctgcgattcatataagttctgtttataaaaccccttcgggggcacaggtcaaatttagcaagtctgggatagggcaaggcttactggcccaaaatggcagatgaggaaaaaggctcagacaccctcaggagcctgcccagggccacacggctcctgagagatggtgcaggaattggaccagagtctctgctgccaagttcatctccctattactatacactcgctacacatgcagttgggaagctgttcctgatcttggctctgttgtctgttacgtgtcctagctgggtgcttagtcttctagggttgccataacaataccaaaagctgggtggattaagacaacagaaatgtatggccttgtagttctggagatgggaagcctgaaatccaagtgtcagcagggctgtgctccatcggaaggctccagggcaggatccctgtctcctcccggttgctggtggttgcctgcaatccttggcattcttgcctgtagctgcaccactccagcctctgccccgtcttcccatgaccttctccctgtgcatctatttgtctgtgtccaaatcctctattttcctcttatgaagacattagtcattgggtttactcaccctgactcatgtgaccagattttaacttaattgcatcagcagagatgccatttccaaacaaagtcacaggtactaacagttaggacttgagcatatcttttggggggacacaggtcccctatgacactgagacgctgccagggggcccctggtggaccacactcatacccagaaggttctgtgcctggtcagtgttctcccatccgtgggttctcctcaatcccctgctcaggcccatgagatgcttccagtaggggctgtgctcatgagtccctctgccaggagggacatgaagtcagctgctgccagcctgtggacggattgtgccgctttcgcatctgtctgagatgctgcaagtgcgtggcctcagtgagtgggtggcagtgcgagcacattgtgtgttccggggagccgggccacctccggctggatgtgtcgccttcctcagggctcctggcagcacctggtgcattactgggtcagggtatcattttgacctcagggtggctgaggaagctatgtttggggaagtggcatggagcttagacattcgagctggcctgattctttttccccaccagatgacaagcgtctctagggcagggatgcctggccatctccatttcccctccagcagtttcaggctcatgggagctgccatgtttctgcagctttagtcccacattgctgtgaccctgtgaggctcccctgggcaagtcttcactctctgagcaccatgcagggctgctgtggggttccatgagatgatgcattttaaaaccatgcacgacttgaaatgcccgcagctctcattatctgggagatgcctcaggacaaagtggcaggacctgattgaagaatagggttgaagacagcacctcgatatgtctggcggtgcagggataggtggccatgtaaccccagtgggagccacttataggaaaaggtggtagatttgggcaaggaggtggcccctctgaaaacctgttgcagtttcaagtgaatttctgaagacgcgtcaagttttagatctactgagtctgcagtgaccatggccaatgggatgggaaaattttctcactagaggagaccagagagagggaacacggactctccagagagtttcgtgagggtccctgccaaggactagtggaaacccaagcagttggggacagggatagtgggagaggtgggaggccacctgggatcttggaaaagaggaagcttcctttttgcagcatgggaggcagcctgggaaagttagggttgcaggatgggaatccagggtttcaggaggcaggaacctggagcaacctgactgggcagtgctgtcagcagacccaagaatactgactggcctgtgaaggaaaagtttgctgcaaagtggaatcgaaagtgaccaggggccaacagggaaggggccgccctcactccttatggctctaaggggttgggtctgttctcaggttctgcgtgtgtccctgattcctgaagctacctggatgctccctgagagcaggagctgcttctgaaagaccatggatcccccccaccccactccccatcaagcagccagcagagtgccaggggcatagcaggtgctcatttaacaaaaatagacaagacccgttgccagagacagcttttgctcaagtgctggagttctcaacccagctgtctatgagaataaccttcccaggagcatttgaaaaatgctcatgcccaggctcctcactttgtattaatgatgcagttggtctgagctggagcctggcaccaggcattttcaaagctgctcatggacactgcattgttaaggttcaccaccagctccgaattgtggctgcactatgtgggcacatgcccggtctttctgggcctgttcagtcatttgcaaatagccttgcagaaatgtacatggtgggtccagtgtgtgcctggcacccagagccactctggctaatgctgattcaaagtcgcaagacgattttgccctgttttggtggatagctcccctgtggagatgactgctcagggaaactggcagatttccagaagagggaagaggagcagccattgctgattggatcatccaagctgggttagcgtctggcttcgagcactggtttaaggtgagcattaaggtcccgtgggatgttgagagtgtttgaggagaaagaacacatctccttggtctagatctcctttcaatgaaaaatgccattttgtcagaaattcccctcttttgggatcaggcagtgcatttgatgttaacgagctctcattgaacacacgctatgtgctgcatttgtgcaagggcttggggaccccctaaatgaattagacaaattagacagtcatgccctgttggagcccagtggcttttgggtccccgttccccaggcaccttaacccaggacagccacactagcaggaggagggcggggagggagagattcacacgtgaggatcaggatttgcgaacttgcggaagagtgtggtttgcggggcccctggcaacagtcctgcttgtcgaaacacttttttcttggtgtaaactgttcccaatcgattgagaaagaagatttggaaccaggcccatgaccttctgcaggtgctgagctgtaggtctatagattgttggaatgttacataaaacaaaaagcccctaaggccatgcctggaagagcaagctctcccacaggtcagcctccttctctgcatattgcacagcttcaagagatcttaaaagaaaggactcttttaagcaagggtcagatgggattgggatgacgcacagggaaggtgtagatgcggttgcagtgaaggagagagtgaggacccagagacctcctgtcctcagccacaggtggcttcctcttggagtccacagcatgtgcatattggtgcagggcactgcgggatggagtgttcatcccagccacacgttcctgctgggcaccacctctctcctgacgataggttggagctgagggcacagaaatggccaaggcagggagtcaagccagacagccagcatctccagagaatagtgacagatgttgtctgccaggtaagtgcaggaagtgcagaacctgccttgaagctggacgagggtcatacaaggtgtcccagagaggggacatctgagctgcatcttaaaggaagagtagcagttagctatgtgcagaagggcagtccaggcaggaagaacagatgtgtctaacccaggaggagagcatgggccagcgggaagggcaggaagctaggactgggcaagatagaaagatctgcctgctggtttgatagagtgagggaagtgtggggccctgttttagctccgtagccaaagacctgagttccagcaaatcacacatgtgtgcatgttgttagagtgtgtgtggtgcgtgtgtgtatgtgtgggtgtgcatgcataggaggaaagggagcggagagttgtcaaatgaggcaagccaaaacccaggcagtgggatggtcatgttagcatctgttttacaagggagttcccgacgcatcctccaggatcatggttcgctcagcctcacattgctacaaagtgggaattttaccaatgatttaaagcccttccaagggcttccagggtctctgatcttcctggcatagctctctggcatcttcctcacccccagcaccctatgcaccagaccttgggaaggtgtttccggcccatttttttcttgctttgaaccacagcacgtgctgttgcccccactggaacactctcccgcttctcttcctccttcagatctcagcccgctgtcgccttctctctgaccctggtcccttccactgcaggctgttgctccggtgtctctgggctgctccaccacgtggtgcctgcccatcatggcatccaccaccaggtggcctttttcttggtaagttccttacaaagcaacatgctttgtgcacctctcaaatcttcaacacctagcgtggtacctggccccaggtgggcacttggtcgcatatttgttaaattattgaatccttgagaaagcccaagctcagcaaggttaaaaaaacgtttctgccagtgagtaatagagtggatattcaaaccggccttctcgctggccccactcctgtgcacctctcactgcacctacccacctgctgcctttcctaccgatctcaacgattatgcagtgagctgtggaagaaatggggctcagagtccggtcttctagaaggtgggcactggagtgagccaggcagggtgtcagggtgtcagtgttcaagctcaatggggaaactgaggtagaaccccagaaatagagattgggctgttccagctaagtagcggcagtgcacaggcatgaccctgtacccactggagacttcatttgtggcatcaaggctcactgcagccccacctcctgggacaaagcacctcctgccctgttttgtgtggaataaagctgggacttccatgaagggactgggctgggtgaggggcaagccagaagctgcaccacaccctctggaactctagaggccattccaagcctcacttgtttttcttttcgcaaaagtggaagcagaaagcctctgctctgtttgccttactctgcaaataaaaatggaatcaggagagtagtagtttgaatcccacttgcaagcagtttgtaagaagtgcccaggtgccccaaaaggtggaaacatttattttccatttgtaaaaaataacactttgttatgttgatatcatgcggcagcagagtactctgcagtttgcagcttgggaatgcaaagggcagggtctccttgcaggcctggctctgggaagcctcctcaccacagccctccatattttccatgacactctccagctcccagagcgtgctgccttgcctgcttagcaggctctaaaatcgtactttacagtttatgccatgattcgggcttgcgttggaatttgttccttcaaatagctctggcatatgtttttatttcacagtaaaaccgtttttaaaagttaacacatgcacattgtcacaaatcaaattgtataggcaagtatatcataaaagccctgatacatcctgaatgcttgctttgtgccaggcactgttctggggatgtttttcctataaactcatttaatcctcgtcagaactttgtccccactttgtgtgatccaggatttgcatccagacagtgcattgatcgtctttgagccccagtcatggacttcctgatgtggaagaggaatccactgccgtactagtggctctttctcctcctctcagtttcatctgtgcttgttaaagtgcttctctctgttacttttcaatctttagatacatttttctccagcacccttgcacagtgtgtctgtctccttatttcataaggtgaggttgttaatccatattgttccttttgtctttcctctcaagcttcggtgccacccacctgctactttcaggctgacattccttcaaggttgctgaagcttgcatcccatcctgaatgctctagcgtatgcattgtccatagtttgactctgaatgttgagaacagtaggtgacattgctataattattgctgcatcagaagtggctaatgctgggttaactcatgcactgggatgaccttttcttctctggagatcaatgccagaacccctagaccactcaaagcagaatggcctggaacagacttgagtgggttctcccgcctacacaatgtcatttgcttggaagcatgccatattgtagtttgcttcatctttggatcatcactttattgcacaggatattttttctgggatttctggttgcctttctttttttcttcttgctttctatgcctttttcatactctcccttttttcataccgcctgttccattgagcctttccccattgtttttctgttttgttttgtttcttctggagagctaacccctctcaggatgctctcccctcctctacccagggtactgcatcctctccagggctgctgcccccaggtcatcttgggctcaccgtcattgctttcctgggttggaggctctgtttgcttaagttacctcctaagaaaaggtacatggaaagtaaagtgtctgaaaatgtctgtattttatgctcacactgaaggtcgatttccaggttctagatcatttgccttcagaattttgaagactttagagttttccttgttgctgatgagaagtccgatgcctggttctttgtagattatttattctctatttgtcttgtccagaagattataagaattcttcttcattcatggggttcatgtattacatgaggatagtctccagggtgggtcttcatttattcattgttctggatgcccagtggccccctttcatctgaaagcccacgtccttcagctctgggagattctaatggaactgattgttttaaaaccttcatttgttttccattctccatatctgagcctcttacttgtcagctctaaaatcttccagaaagggattatattcttctacatttttctcatttctttgcctttttgctctttattcgagattttgttgacttcattttctggtttgtcattttgcttttttttaacttttaaaaaacatgttggcactaacatttttaacctctgagagctttttcttgtctctgatcatttcttttcctggaatctattttcgttttatagctactagtatactgagtgctggaatagtaattagagcattttgtttgtttgtttgctttagtccatgaattatttctgtctcctctaaggtcagtttttgattgttttgactctgctcttcctgctgctcactttctcctgtgccttttcgtttcgagttgaaaaaagtctagcagctgttgtgagattgttctttggccaatgagtaaacaggctgagaaagactgggtaactgaccaggatcacccaggtagaaatgactagctggtaaccaaaccccagccttctgatttctactcagcttcccttccccccaaaacttgattgatttcaagtagattttaggccaagacttgtcccactttgctgattgcatggaggctggcatctcttggtaactggggctgtgggagaagctgactttcccatttcccaccactggtctgtgcctcctctgtggtatgctggaggacccaggagttctgtggttgtcaggagaccatgcagccacatctgggatggttggtggcttctcattggcctgatgtcctttgtcgaaggtgaggccccagaatccactcccaggtatcccacagccccccacaaaaagctcagacttctccctctcagaacaggagaccctcagctctgagatggggaccacagtggagcagcacccactagaaggattcctgggtccccgaggcttggttagaagtaaatcttcacctgcatgcagaataattcaagggggtgtttgactgcaggcaggctgcctgtcttcatccatttgggctgctataacaaaatagcataaattgagtggcttctaaactacacacatttatttctcacagttctggaagctggggattccaagatcaagttgccagtagattgagtgcctggagagggcccactcggtggtttgcagatgaccgtcttcatgctgcctcctcacctagtggagggaggggtggagagctgtcttctggggtcccttttataaggacactaattctattcatgagggctccaccctcattacctaatctccttccaaaggccctgcttcctaatactagcaacttgagggtgaagatttcaacatatgaattttggggggacatatttagatcatagcagtgcaaaattaggaaaatgtggaagaaaccattaaaccatagatattttaactcatgtcaccctcatcttctgctcctggaactttctcctatagaatattctgacttgcagagagaaacagtgaaatcattcaaaggaatttctcggtcctccagctttgggatgctccttaaatcacatggaatctgagactgagccatttattgggagcttttctttattcctttttttcccccatttattcagcagatgtatatgaaatcttcctgtaaacataaaacgatgcttaaatacaagaggtgagaagggtgcagaggcaattaagatgtggcgtctgccctcaagggccctgcaactcagagggagagacaaacatgtaaacaggtgcactgtgaggcgaagggaaggctgcgctgctgggaggtacagttagtgggctgcatgattgcggggaaaggagcgatgaattgtgctcgggggaactgaggcagactggagcagagacggcaccagggctgggctggacaggaagttgagtgttattagatggaaccagtaaagcaaggcatggcttgagcaagagccaggagtcagaggctcacaagtgccaggcccatcccagggctgctggccccagttggtgggagtccagggtagcaaaggacttggccatgcgaaggtttgggtttcttgtctggtgagggcacagtgcctccttcttaggtctgtgctggggagtaaatgagccagccagggcaggaggtgggctccatgctggttgcatagtaagccttaatccaggttagctgtcattgcttatgacaaggtggccaacagttctacatagccttggagcgcatactagtttggagagcaagtggtgccgggtttcaaagaactgtgggcattaaaaacagttcatgacaaaaggggagaagcagatgcccttagaagggatgcagccaccttctccacatcgccattttgtggacaggcaaacaggctcgtaaaggacagatgtagctcatttatgtgcggtgagacaggactgaagccatgtggtttataggtgccttttgcttctttttttgtttagttggctagttatttttgtgccctttacctatttttaggagcgtatttttccctgctttttagtttcagtactcatatataggtttctctcttttcttttctagcatcatgtttgagatgggtaagagacagtccaggcaacagcttcagaaggtgtgtgtttaacggacaagcaagcaagtgctgttgtctggctcggtgtaagagctttctgaccggcagagctgacaggagccattgcttatggactgctttgggaggtgattcatgcagccccggaaatgctcgagcagaaatctgggcaaccatctggtgaaactagtagagaagggaatgaggattcaatgagtggtcagactggaaaagcccgaacattctcttcctccccagagagttgggggccagggattctgttcatgtattcagaccctccttctgtaagcattttgtgagcctctcctgggtgccaggccccatatagatgccaggaataaggaagttaagggacagaggcaggagatgtaaattttgctaatgtggggcacaggagttaatcttgtggatttgggctcaggacagccccaagggttgacagccctggcgcctagcagggccatcgtggacaaattacttaaccccaggaaccacaacttccttttctggaaaatgggcagatactcattcattgagcctctgccatatggcattgttcttggcacaggggctgcaatgaaggacacgattgctgtcaagtggcttctcttcaaagtagggaggagaaatgaaaaaataacatactttggagtagggaatcctactttcttcagtactttgatgaaaatgaagtgtagggtacatagctggagagtgatgggaataggggacctttatagacagggtatcctggaagacttttgctgcagggacacggtatctgagcaatctgaatgctgtgatggagccagccagtgcaaacgtttgggcaaagtgtgttccagtagaggagacagccagtgtaaaggccctggggtagtaatttcaaaaaagatcaaggatgttcacatcctttagttgtgatgggattgacagagattgtgtaaagatcacaatcctttagttgtgatgggattgacagagaggggagagtagcgggaatttagatagctaggcagcagtagtatcaagtgtatttttccagtgtagcaccttatagcaaagtcattttttttcaagtttttttttaacccctgttagtctggacaagtattggatcaaaattgtaagcttgacttctccctgcatgtcagccgcagtttcttcaaaaagttatcattcagaaggatgctatttccaggctggacgcaaacacagttggagggatccatatgcagagatgagaatttttgtatctcagaagatggtaaaacccacccagctgtctagtcatgttggaaaaaaatcacattaaaatgcaaatgctcctgagtaagtgaaatgttgatgggtgcagcccgccaaagaaaaatattcatgaaatacaggctgttgatccacagctagcatggccaagccatttgctcagcaagacctgagtgctaggaaatcgcacttacgggagctgttctgtgcccttagcaaacgctgatctccccaggggcatttggaaatggggacgctcaagtgctgggtaatcatggggatggggtgggggagcctgcttggtaaaaggacactctggccacattgctttcatcgtctatttgaacctctcagcatggaccttggggacaaagactagagacggtgtcacctccaccttcccaagaggaaggggtctgcatttccctgcatcgtttcaacttgtatttctgagcctatcagggactctaagctggatttccttaaaaagcattctcctttcatgggtgggtctttgaaaaagcattgagaacatagattttctcagtaaatatctggtatttgcaactttgagccataaaatgtaggagtggagagagagaaaaaaatgtgtaccagacatcatgattgtttcccattgaatccatacaacagtaatcaggtgggcattgttactccattttgtagacaggaaagctgaggctcagaaacaatagagtggggccatttagagcatggccttggcgaacatgagagaatcccagctctctcacaccctgaggaaaggggagatgtttctcccgctcgctgattccactttgcccatttataaaatgtgatgatagtgtcttcctctcttctgttgttgcaagcattacaattattgatggacataaagtgcttagaacattacttggcccctgggaagcagtcagcaatgctaggggctctgctgactgctttaaatgtgaccacagtcactcagcaagcagaaagagatgatgacatcagcacgattgtccctgtgcagaaagaccaagctcaaagcccagagaccccttgagatcaccagcgacaaacattccacacagatcacaaatgagcattgttctgctcgcagagttcttgctcagttacctgtggaattattctccccactttacagatgaaaaaaattgacattcataaaaagccctcttttccttaaggattgcaaacaaaagcctctttcagccagtgttcccgttacctattgctgtgttacaagccagtctaaaacttagtggcttgaaacagaaggtcgttattatctcatggggttctgtgggttgactggactcagctggtggttctcactttaggtctcctgggtactgggggcagatggtggctggggctggagccactgggctggcagctgggctgggctggccggcacagccagggctgtagggcttctctgcccatttctctccacctggctcgctggggcttcctcacagcaggtggcctcaggggagttggatactggcatggcagccagcttcccaagagggagtgttccaagacacaggaaatggaagctgctgggctgtaaggctggcccaggaacttgcatgagctctcacccaaggggagggaacatggacccctgcctcatgattggaagggagtgagtggccatctataatcccccattgctgggcaaggtggattttgcagatcctggagggccaagtatgtaatagttcactcccctgtaacatgggttctgctaggtccctcagcataaacctggagccttgcttgatcctgctggagacataggccatcactggctcctgtgggggggcctgggtggttggcttagactagaacctgcctcactggggatctgggagaaggtcactctggcagacagactgaacccaggcaagcagtcaacatgcaaggcctgtggaggatgtgctggtgataggcagagcacagtgggagggagtgggagaggaaaggtgggccctggaatgattcaggaaggcaggcaggctgaccttcaggcctcaggagcacagccaaggcaaccaggcaggtgcagggcagaccactctctctgggtgagggataggtatgaaagtcaacagcccaggccagggtcaccaagcagcttcctgggacaagagctcagccagaggccgagtcctaagaggtgggccacactgtgtactggtaaagcccaggtgtcatccctgaaacacagaagctgtggttcccagaacccagggcccttgaggctcagccccatagaggtggggagccccttccaggcctcgggccctgattgcttctgagaaccaaggcaggtaaggtctgcagagaaaagtccaggaggtggaggggctgcccgggctgggtaccccgcagtgcctgagtttatatcctcttcccctcaggacgctagccctggctgaggacctgcgcaggatgttccagagatcccttcagttctggggctttctgtaaccaaagactgtcccagagcctgtcaccaaaaaccagctcattccacaagggccctggaagctctggttcacatccagcactccttagcctctgttccctgcatcctctagaggcattgatactagagcaatccttaagtgggacttagcaaaggccctggtggtttggtctaagtgtttgtgaaatcattcaataagggacttaaacattacctctttttaaaattttgaactaatgtagaagtcatttccgcacccagtggcccctcccgtgaacatcttatataacctgagtgtaatcagcaaacccaggaagttaccaacgtgtaatactattaactcaattgcacaccgattcagattgcaccagttttcccacaaatgtccttccatccaggatcccgttccagatcccacactgctcagttgccatgtctccttattcccctccaatctggggcagttcttcagtctttctttgtcttccatgaccctaacacttcagaagagcacttgtcagctattttcttaaatgtccctcagtttaagtttgtctgaagttcttttttggactgaggttgtgcacttttggcaagaatcccacagagctcatgttgtgaccttcttggtgccccctatcgggattcatggtgtggacatcactggtgacattgacctcgatcactgggttaaagggatgtctgccaggcttcactgtaaagtcactgtcttttcttcgtaattgataaataccttggaggaaatactttgagaccatgtgaatctctttctcctcaaacatgagctcattacttttagcatccatcggtagatcttgtccacaataattattactgtggtgattgcctactggtgatttttctgtttctctctgtctttgtagtcctacatttatttattggaactctactgtaagaaagaattggtctttctcccccatttatgtatgtgattatttacttatgtcaatgaaaactcatagacatttcttttatcctgtgatttataatctaatcctgtggttatttattttcttgctcaaattatcccagctttggccattagaagttccttcaggtttgctcttgtgttttcaaccagcccctccacccccacctgtttttggaagacttccttaactttctggtatcacaagatgttcaaggcttatcttgtatgttcccttcctcaactctggaatcaaccacttctccaaggagccctggttcattttattggagaatggcatagagaaaccaaggtttgggtgccaggtatgtttattgccactgagctgtcattgcttttaggccttttaggggacatagctgggaatgatatggacaggcactaatccatgcgtgcacactcatctgtatttctgtgtccacctacctggatgtatattaaaaaccacgtgtttatactggtatctctaattctagtccaacatcacaaggctcattttaactttttccctttcctgcaatttttttccccaacagcaagaaactcagcttttgttagctaaaatatatttatttaattctagtatacactaaagtagtttcagatttattaacccatgtccccatgagaagcacatttacccaattactgagtaggtgatagcgtttgtgtacagtctttttgtcctcagccttatgctatccaatcaaaatactgttttccaaaattacttaggtgagttcttttctttcccacccccttcagtgtggtaatactatttatttgtaatagtttggtccacttattaatgtttacattccattttgggtttccttccggtcttggtaggtttgaattgctttgtgtggacatatgaaagacatgctaaacatcgcaatgctcctgagtcagatctatagcaaaagatacactcagagaagcatcacttcctccccatcctcgccatcgtgatcctaccccactcttctctgcatccctttctcttccaccacctctagggaaccagtctctttaatttctagtttacccttcctgtatttcttttgcataagtgagcagatgcatgcatgcatttttgtagcccctttcttccatgaggtgtagcatactgttgtatgttacatgtctgttgcatgcactttcacactttgcttttctaagttaacattgggtccttgaaatctctccaagtccattcatagggtccttcctccttcctttttgccaccacatcgtactctgtgtggacatgccatggtttattcagcccttctcctatatctgagcatttaggttgcttttcgtatttttgcatttacaaatgaggctgcagtggatgaacttgcgtgtgtgttttcatagcattggagcttatcttcagggtagagtccaagaaatggagttgcacagttgcaagggaaatgtatatgtggttttgttaagtgttgccaattttgtttccagaaagctttgccttcaagggttggaaaatagttatttcttgttggaagtcaacggtaagcataaggggcaaggtgggggtattgctactcttcttatgggatctttagaatgttgcttttctggccagaaatctctgtggccagtggtgcctttgcccaagttcttgtccggcatccaggaagaatgaggtatgcagacaagtggagggtgagcaagatgaagaggtgctttactgagtgttacaacagctcagaggagatctgcaatgggtagctcctctctgtaggcaggtcatcccattgagcgtacagctctcagcagagaagagaccctggagtgagtggcttctttatgccagcaggtcatcccaccatttctgcagctctcagcagagaggaggccctgaagagggtgactcctctttgcagctgagtctcaacatctgtgcagatctctgaagccctcagcagagaggatagatcctctctgcagctggtcctcctgtggtctctctgtcctctctgacctctgccctgctctggctgaacctggggcttttatggacctcagaggagaggaagtgtgtgtcagttggtccatgggcagccatgggtgggcctggaaaaggcaccacaagtccccagtttgatctgcaggactggcagtctggcccccagccttcaggccctccctggccttaaggtggagcattcctagggacctgcctgcttctgctcaggaatctgtctgcctcctgatgctgttcatggcacctgggcttggccccagttttgctctgagatcagagcagatgccaacagcagggagaagtcagatagtgggaagaggcacttccgaagctatgagggcagggatgacttcccaggtccccaagagtgcagggaggcctgagtctgcagccatggtttgggcagctgcagctgcacccagtggggtggggctcctgcctactcagccgctccagacgacctgccactgccatcactctgatggaggctctttctcaccaggcaacgatctgtcaggcaaagtgcgtcctcccatctgtcctcttagcatcaaggaaaggcagatgctggtctctcatgacaacttactgaggactctcatatacgctgcctcgttttgtcctctaacaacatcatgaaggatctgagcttactctactgttggctccattttaaaggcaaggaaactgaggctaagagaagttaagagattttcccttggtcacagagttagttgggatcacaagagtctcaaaatcagttttctcagattatggccttcttcccctctccatgtacactattggaaccataagaggccttggctatcacccagtttgagcccatcatgaatccattacagatgaggaccagagagggaagttgatgtagtttaggtgacacagctcagtgagggccatacctggaacccaaatccctgggtccttcccctactccctgttagtcctgggaattggaggtagagtagccctggcaagtggggtccatggcccagtggaagtggcaggtaggcggggggtgacgttgctgggctggaggtctgcaccacaggcctgcgtctcatctctgctgttgaagcatcctttcctcagagatacctgatgacttgggttcctcagggaagtctggactaacagaattaacttttcccacaagtgaaaaacgtgttctcgttgagcaaaggaaattttgattaatttacccttaagtgtcagtacagggagctgttttttctctttagatcagtgtttaaacttttctcactcaacacacagtaaactaatcctcctttccatcagacttcagggggagaaagaaaataaacaaggttatccttgctgccatctctttttttttttttttttttgaggtggagtctcactttgtcacccaggctgggctgcagtggcacgatctcggctcactacaacctcctcctcccgggttcaagcgattttcctgcctcagcctcccgagtagctgggacttcgggcacccaccaccatgcctggctaattttttgtatttttagtagagacggggtttcaccgtgttaaccaggatggtctcgatctcctgacctcgtgatccacccgcctcagccccgcaaagtgctgggattacaggcgtgagccaccgtgcccggccgctgccatctctttatagggaaatccagctaggtgggctgggctaggctgtccctaccccccatctcagctgcctctcagagtgagccaatgcatgcactcactctcagtactgaacactgcggctgccccaggccaggctcaggggccagaggacatggaggtgaatctgacccacccaggcctgtccttccaaaggagctcagtttagtggggaaagacccaaatcaagagatggtgacaggatagggcaggagttgcccagacatccgaagacggggtcctgggaaatgctaccaatggaatcgagcttcaaagggccagcagtagttcttcaagccaggaagagcatgtgaacaaatgcacaggggttagagccccagcaggcggtggtgggactggaatgtggggggcatttgagggcaggcaggagatgggcagcacctgggagtcatgttggctgcgtgatttaaatcgcaactcggtgtatgatcatttctttacttttttcactgccgtatccctagtacctacaaacttcctggagtgttgcagagcttcactaattatttaagtctcaattccttatctctaaaatgcagataatgcttatttttgtctgtgctgtcgctgtgtctctagaatagggtcttggctgggcacggtggctcacgcctgtaatcccaacatttggtggaggtgggcagatcacttgagcccaagagtttgagaccagcctgggcagcagagtgagacctcgtctgtaaaaaacaaaatagaatggggccagcgtagattaaatactaaataaatatttgttgagtgggtgaatggatggaggaactgtgtatttattaattagtagctatgacgtttatcatcatgtgtggctggatagtagctactggccccatcatgacagatatcaagtacaaagccagatccagcaacatcttggcaattagggaggggaagcactgtaattaatactaatcattgtgaaccttcgttgatcagactaaatgctttacagatattttatctcttcactggttctttggaactcctgggagtaattcctatcaccagggatggcctggctgccgtctcccttgagtggcttgtctgatgacagccaggccattctgtggctgcctgtgctgggcatgggcatgtgtggaggagcttgtcctttggaaaactcttgcccagcccctgacgaagaccttgcctgggttcagactttgtcactcagaggctcccagctcatttcctgaaagcctggaaggcagctgtggaatgttggcagagctggcggccaccctgtctagacatttagtcctggagagccggttacccattttacttactgtggtttgattttaggagccaagtgagtttcaaaaatttaatataaagtatctaatgcatacaagagtatacatagtgtatatgtgtgattgaaaaaataaacaggaattgaacatccatgtacctattgcatctaatgaataaattccacaggtgccttgcatgacttacaagggcctctgttctagtccccgcttccccctccagcctcagctcttaggacagccccctcaccatgctgctgcgccagccctactcgatgtagcattccgcacttccacattttcttcacatctgccagtcccctgcctcgttgcccttctcccaccatcagctgagatggtcctactggcctttgatgtctcagctcagacctcctatcttgtggagacagttcactgcgtgccctctctgcagtgccctgggccctcatcaccatagtgatcaatttgtgttttccgttcactgggccatgagctcgttgagggccagggcccttgtcttccatttgtacatgcccgttgttatgggcagctgtgttttaggtgaccactgaggtctcttcttggaagggagaagttgatgcttcctctgtgttctggcctcatctgctagatttgtcagacaacgatgctaaatttccaggcaggagcttgccatcgtagataggatcagcgtgaaccttccccgctccaaaatatggaaatgttctcaagacggagaaacactcagaattacagttgagcctgagccactccattgaaagcagccagcaagtaatggaaagaatttggatagaataatccctgtcttccttttccggaatgtctggtaccttttagcacatcagggagcaaagatttagttctgagactggcattattttgacaaacaagttggtactagaattaaatgacccaaaacccaactcccattcagcctaaacatctctgctgtactatagaaaggctgtcagaacctccttcatttgtcatttttcacatacagcaatggccccttttggttttcaaattccagcctctcaggcagagagatactgacatgaagatttctccttgcataccggcgttgttcttgtcacttggctggtgaggttctttgaggattgttggaaaacagaagcactcgtagtcttcgtagttttatttatttatatattgattgctttgaacatgataaaagtaaattaacataatcaactatgttatagaacatttctgaatttttcccccagcatgtttttcctaaacaagtaaggttttaaaaatcttacttgcactatattgtactttgtatttttactttagtccccataatcatgttgaatttatgtgatcattgattttatttaatatggaaaagcaaatttcttcttaaatttacattacctaatattctcactggctacgttctgcattcgacactgccttttattgtaatattgtctaaatagatgcagaaaaatggaattttctctattaaagtattttacatttgaaatataaaagaactagataacagttttctattcaaatgtgtttattttaacattgtttggttaaaaaagatagatgaagttccagtcaaccactttttccccctgaaatttcaagataatgctgtattaacttttctagatctaacactagcttatccttccctcttacaaaattgtttgaacttactgagaaaatattcccatcattaacaaaaataaactatttaatagaaaaaaattatttgcagtcataagtagaactgaattttaatatcctgtgcttttccccttatcacatcgtgggcatcttcctttttttctttttttttctttttttgagagggagtctcgctctgtcgcccaggctggagtgcagtggtgcgatctcagctcactgcaggctccatctcccaggttgacgccattctcctgcctcagcctcccgagtagctgggactacaggcgcctgccgccacacctggctaattctcttgtatttttagtagagatggggtttcaccctgttagccaggacggtctccatctcctgacctcgtgatccgcccgcctcggcctcccaaagtgctgggattacaggcatgagccaccgcgcctagccgggcatctttttttttttacctcatggtctttgtcaccatcattttctttcctttttttttttttttaaattctactctaagttctgggatacacgtgcagaacctgcaggtttgttaaataggtatacatgtaccatggtggtttgctgcacccatcaacccatcatcatctaggttttaagccccgcatgcattgggtatttgtcttaatgctctccctccccttgtcccccactccccgacaggctccggtgtgtgatgttcccctccctgtgtccatgtgttctcattgttcaactcccacttatgagtgagaacatgcggcgtttggttttctgttcctgtgttagtttgctgagaatggtcaccatcattttcagctgccaggtaatgcatcagtgagttgtaatcacacgaatttttcattccgcaatttactattgatcactgagtggcttggcaagggacaaactccatttcttagaattggctctgagaaattggtctagagaagtcataaagaggaaacctcaccagcaaatagaggctgcagaaagtgccaggacccagcatcttggatatcgctcagccatggtctgtccagcagggtcactaacctagagacctctaagtcctagatggactggactttttttttttgagacagagtctcactctgtcactaggctggagtgcagtggcacgatctcagctccctgcaacctccgcctcccaggttcaagcgattctcctgcctcagcctcccgagtagctgggactacaggtgccagccaccacacccagctaatttttgtatttatagtagagacggggtttcaccatgttggtcaggatgatctcgatcacttgaccttgtgatctgcccgccttggcctcccaaagtgctgggattactggcgtgagccaccgtgcccagcccctaggtggactttatagcaaccttggataaatatgggccagaggagaaggcaaacagtaaccaattgacagccttggaagagtgctaatgaactagttggtattaagctggaaacctagtcaaaaactggaaggtgagtaactgtatggagagggtgcacatccagtgtgtggatgatctgaagctgggaggagagtgactgtgtaggaagacaatcatctagaagccaaggcaaactcaacagattggcacagtgggcagaggtcagccccctggactgtaatgtaaatactaagtcctattcttgggttaaaaatgctcaccttccacaaacagggagcaatgtgattttgtagcatcgtaagtcatggcatactgtggtgaccccaaagtgaagtggttcttattagcatccatggatgtgccacatccaggagggagaggacaaacctgcccagtttgggctgaaaatctttcccttatgttttccttatgcatgctgtgattttagggtgggccttcccaggagaagggatcatgattaggagtggctatgtggacaagtagggaacagaaggtgcttagctggacaaaagggcttgtgaagtcatgagaatgagcctctgtcatcattgtcatcatcatcaatcatcatcatcaccacttaatcatagtggctgccattcatcaagctaggagacttagaactaatgtctttaatcctacaagctactgttatccctactttataggtgaggaaactgaagctcagagagatgaagcagcttgccccagtcacatagctgataaaccactgagacaaaattggatcccagctatatctgaagccagagttgtcattccttccgtatcaatttttcaaaaaccgtggtgctcccttgcagaggataacaaggacttgcttttgtttagttcctggttataaaagtagttccagtgggtgcaagctaagcgagaatattttgttttaaagcaaagggctttcctgactgagctgtcggcaggtagaatatacttcctgagaggtggtaaattccagaatgataggaagtcttcaagaggaggcttggttagcactgtgtgttctagagggagctcaaagaagccaacaaaataaccttgaataccccttctgtacaagtaaaagctctggttgcatgcaacagatactggtaagaaatgggttccaactgccttaagcaaaaacactgttttttgcagggatatggggtagttcatgggatagaaggaaatggtgagctgagctttaaaaagggcaaaagtcagcctggctgcaggcatccaggcggcagcagctaatggaacctcatttcagcaccgtggctaggatgagtcagtgtttacagttgacccacctgctatcaccctacctaagactaagctccagagacagagcatcttataggcttagccaggatccagacccatccccatggcagcttgattgacagcctccattaggaagggtaattttccagaggaaaatcgagaccaaagaaagaccatgaatgctggttaggcccagtgagccatgacctccgtgccttctagccctgcccggctgggattccacactgaaccctgagtccccctgcagggctctccctagctgctctgcagcctctaggcccaggccacacacggcgctgtgtcactgtatactcgtggtttattttccaagacacgcatcctaattaagcaaatgattaaaaactctcaagtgtgctcatcggaagcagcccaacagaggactggcttgctgggaactgtgcttgaaagtgagttgcccatcgccttagcacagtaggggtgctgatgaggagcactctgtctttccagaaaagtggctcccttcctggttaccatgcggggcttcttttggcattcagcacagcacttaatatacccagtctttaaaaccctgtgttttttaaaaaaaattgtttttgctaattaatttgttttaatatcagtattgttttattgttaattatgcagttaactagtaagtattaaatcaccaattaacttattaagtatggaatagatatgagaagcatatttagaatgtaagtataaagagcaagcgctcatgtacccaccaccagcttgagaaatattaccagtggcttagagagtcctgagcatcctctccatcctgtccacttagtgggaaccactacgtcggctttgggatttattgttctcttgtttttctttgtgtttttatcacacttgtatctccatataaaatattgttagaatctccctgtttctgaacttcccacataagtgggaacatcctttctgtggtcttttgcaacgcgcttttgcactcgatattgtatttgcaattcatccatgcgatggcacgttccagcatttcattttttcctcgacgctgtgtgtttttccagcatgagaactcacaacggtagatccaggccaccgctgatggccattgatgctgggtccagcattttgcttatgctgacattgctgtctttaaatgctcttatccatgtaccctgctgctcatttgcaggtgtactcggtgtgtatctcaaggtggcatggctgggtcactgaggtgtgagtatgtttggctttataagataatgccatcctgttttccaaagtgacagtatccactgatactcctgccataggtatctgagagtccctgctaccgtacagactctgtcagtgttcagtggtcttgtcagatgttttagttcttgccaatctgatggctgtttgatggtagctcactgtgtttcaatgggcatttctctggtactgaggtttagcttctttacggctgtttactcttttgtaaaccatgcctggacatggttttgcccagttttctactggatatttatcattttcctactcatttgagactagaatgatgtatagtgtatatcccagtttgtggcttaacttttcacttttgatgatattttatttttttgataaacagatattgaatttaaggtcatcgaatttcataattttccttatagtttgagcttttatgtcttgttaagatatccttctctaccccaaggtcatacagatattcctttatattgccttataaaagtttcgaagtgttctttttctattcttatctataattcatctggaactgatgaactactgatttgatttcatttattttttcatacagatactcaggtattccaacactgctcatcaaagacccgtttacccctgtggatcagcagtgtccatgtgtgtgtaactttgtttttgtttctttggcctatttgtctaaggcttgtataagccttagacctaagacatattgatgccctatgaggcagatctccctaccttattctttagtaaacatcttggctgttattatccatttgctctttgatatacattttagaacctacttgtcaaatatcaccaaaaaccccatagacattttgactggaactgcaaaaaacctatagaacactttaggaaaaactgatgtttttaggatattgaatcttgcttattgaatctagcattccgtgaagatggtatgtcttctttttcatgttggtctgcttttatgtctttcagtaaagttttacagtattcttcatcaaaatttcacacatctttattagatttatttctgggcactttatatttcagatactatcacaaatactgttttttaaaaattaacatcttgattgagatataattcacaaaccacagaattcatctatttgaagtgtacagtttcatggctttagtatatttagtgtatttagggttgtgcaactgtcactaaaaatctaagtttagaatattgttgttactccaaaaagaaatgcctttactgttatcagccaatccccacttccccctccacccagcccctggcaggaagaaatgagtaaatgattgagtggataaatgaatgtataacctttagcaagctttatgtcagacattgactggccccagcctttgcttgttgtttatttttaattttttaaattttattttttaagttttaatttttgtggctacatagtgggtgtatatatttatggggtacttgagatgttttgatacaggcacacagtgtgaaataacacatcatgaagaatggggtatccatcccctcaagcatctatccactgagttgcaaacattcccgttacactctctaatccattttaaaatgtgctgttattattatacttgttgcttattgtttctgttttcctttcccatctctgttattgttctggtttctaggctaatctcctggattctatgagtctcctccatcactgttcatcctccagaccctggccagacaactttttccaaagaaaacaatattctaacttctccatttaaggaagccctcagtaactcccctgggaatcaagccacactcccaacgtgttgtctacaggggaattgaagtttccaagttgatgacttaagcaacttggaaacaaacacccgaggtgcaactcttctgtgagtcggagaaggtctcttctaggtctttgtttgcttcagagtcctcggaaagtaaacacagctgacctgattattcccctccacttcctcctgagtcagagttatctcgagttaattcagggaagaggctaaattaagccttgaaaccaagcagcctccatgacaggcgctttgttttgcttgagtgactgtgatgatgggtctttggttataaaggcagcactaattgtatcttcttataccaatcctggccatctattccctggcctgtagagactgggagatgccaggttgccccagagcacccactcattcattcagcacaattttcttaagtgcctgctccatgcccggcatcacgcttggaggtggggattcaaaagtccttcctccaagggcttgcagtctttctaagacgacggatgataaaccagagactccattagagacatgactagtgcttggatagacatctgtccagggcagtaaagggagtggatttctaagattcttacaacagacttctcatgactttgtgcaaagtttgagctgtggagtcaccaaaataaaaaggggggatccactaatacctacaaactagcaaacagacacaaccactttgaaaagctgtttagcagtatccactaatgtcaaacgtatgcgtaccctgtgcccggcagctcctcttctaggtatgtatgtagtaataggaaatgcacgtgtgaattttacattaaaagagaaaactgtaaataaaaactgtagttaaaacatgcagcatgctgcagtgtttacggggaaatgaaatagtatctgcagtttaggccaagcatggtggctcacacttatgatcccagcacttagggaagctgaggcaggaggattgcttgagcccaggagttcaagaccagcctagcaacatagtgggacccagtctctacaaaaagaaatgtaaaaattttagctgggcgtggtggtgcacgctggtggtaccaactgcttgggaggctgaggcaggaggatcgcttgagcccaggaggtcaaggctgcagtgagccgtgatcaccccactgtactccagcctgggcaaaagaacaagagcctgtctcaaaataataataataatagtaataatgatatatgtagtttaaaatgcacccaaaaaagaagatagatgaataaggaatgggcagatatgtgacaaagcaagtatgggaacatgttagtaatggatttgagatggtgagtttatgggtgctcactgtaaaattccttcaaatttgctgtatgttaaaaaacttaatatgaaatattgggaaagatgtatgtatatgcttgcccgaatatatatacaagaatgttcatagcagcattattcataatagccccaaacttgaagcagtgaaaatgcccatcagccatagaatagagacataaattttgggtgtagtgatccagtggaatactgttcacatataagagtgaacgagccacagctatacacaacgacgtgagcaaatctcacacacagtgttgtgagtaagaaatcagactcaaaagaggacatactgtatgattccatttacgcagaattcaaaaccaggcaaagctcaccaatggtgctagaagccacaataatggttttcaggaggtagggatagtgattggatggggcactgtgggaggcccctgggtgctggaaggctctgtttcttgatctcggtgctaaacagatatgaaaatgtatcaagctgtacatttaaactttgtgcactttcctgtatgtttactatacatcattaaaagtatacgaggggagaaaaagcaggaaaaccgaacgaatccaactagaagctttccctagctgagctgtgggagtaggaacccactgtaggcctatctagtaaaccgaagttgtgaagaatatgaaacttgcctttagggtgttcatttgttcacttatgcacagtttcatgttgcatcagttcctccattcttcactgatgtgcttgcctctcgttcatacggatgttcattcacatgtcctgtcctccggatccagagccgctctgtaaggtgcgagcgacccagccctttcaggggctcatgtgcacagggggagggcatgcagacgtttcatttcccatctcatttcacattcccacattcctggattcccgtttgtgatccttcctggatatgtgccctaagatagcattcgaatgagagaaacagaactggtaagatatatataggtgtatataaagagatttattatacagagttgactcgtgattttggagaccagcaagtcctgagatccgcaggatgagtcagcaagcgggagacccaggatggccagtggtgtggttccatctgaagccctgcaggctcaaggcccaggaagagctacctgaaaatcaacagttcgagtccaaaggcaggaaaaagccattgtcccagcttgaaggcaggcaggcaggaggaatttgggggaatgtcagcctttttgtttcattcgggccttcagctgattggtcagtcaccacccacatttaggacagtctgatttcttcagtctcccaattcaaatgttaatctcatcctgacacacacacccagaataacgcatgaccagctatctgggcgtgcatgacccagtcaagctgacacataaatttaaccatcatcaaaccctgaagcgtgaaaagcctcctggctctaaaggcacagccctccagtggaagaaatgtagctatggggctggcctggtgcacatcacatcacaagtggacgggctgccaccaccacacacactgatcctattttacctgtggtttggaccagcaattggtagaaaagaaggctttggctgcccagtctgcctcctggatggccatgttttctgtcttcgaaaataaaaagttattttgattattgcaatacataccatgcatacaaaaagagtagctggaagatatgcctgcagtttaaaggaacagtttaaagcttaacagatggcagatgactagtatctgaaggccactggtgcccctccctcatggcagcctgctccactcttgcctggagaaagccactctcctgagttttgcgctagtcactttggtgctaatcattccattactttttatgaaaatcaaatagcacatgtctaaaacaatagatgacttggttttgcctgtttcgagcctttataaatcaaattgtactgcacaaatttgtctgccatgtgctctttccctccgctaagtgtctgggctttgttcttcctgttgcctgtagttctaattcattcatttcaccatcatataatattccattgtagagactgaccaccacatgttcatctgctctcctctcggtgcatatctgggtaacttccagttctctgctatggcagatgaagcccatgggagcagtcctgtgtccatgcctccaggtgcacagaagtgaggccttctctagggtataacctggcagagcaggtgcccagtggtagaatatgtctgttcacttttctagctaatgcctggaaactttctggaatgattgtagcaatatctgtttctaccagggattatgagaatttctcatggcgttactcatccacaccgtgcatagaccctttaccatcctgcctggtctcaatgaatcaccttccctggcttccagccacccctacccataccgcagtcagagctttagcatggtaggactgtgatgccccatacacactttgtggatactcaggacagcatgtttcttgcgtgtaacccaatatgtgagagtatgtgaaattcccaccaccaggatggagggcacagactttagtttcactgcagtgcagctgacccagtttctccttcaagggaaggggggaaaaccagctcaacaaagtgggtgatgcccgggtagacttctaggctcctctctctgtaccaatgtcaggacactcatcttctaaaccaattagccgtgttctgcctttttcccatggccaagagcaaggtgtcccaaggtaggatccttgtgggatttgtcattctcccaccatgttctgacctgcaagcagatcactacccactacagatctgcctggctatggagggcatgcttataaatgatcatcttttgtgctgcctctttccaattacaggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacagtgaacagaataaacaataaaggtgcaatggaaaaaaatactcgatgtcttttctttcaacattgtgggatataaaacatttcaatgtcagtcctttgcctatacatagtgtttatttattaaaaaaaaaaactgaatgtgatgctgttaaacggagactattttgtgtggactatagaagcctcagtggtttttcaagtatacgaatttgaaatgtattgagggggaaaagtgcctttccaatcctctgctcccgggatggttcttctaagttgtcctaatccacagcctggaaataaagctgcctgttcaatgttgaacagagcagtgatgccctttcccacagctccagcatgccctgtcttgtttcccttctaatttagtagagaccatgaatacacactgggcaaactcatagcttcccccagatctaaagccatcgcgaagggacgtggaagggagaggctggcagtgcccctccatcctcaacatctgagtgagccccaagcccagccttggccagcaatagcaatacccaaaacaatgccagggccatctactctaccaagcactttctactcatcctgctgggcacagaacaatcccatgagatgtgtgtttatccccactttacaagatgaaggaaaaaagcaaatcgacttttctgaaattgcacagccagaaactagcagaatcaggtctttgccccacgtccaccagccgtcagcaccttgcctgccccaggtggtgtgatgaaccatctggctagctcagtcacaatatacagattcccatcagccctggcacttcttgatcacaatacagctggccctgtattgatcacaatacaactgatcacaatacaactggcctttcacctctcctctgggaaggcaactttgaaaggccgggtcctagccccggagggccagccatgctgctggaagtgtagcctggtggtttggagccacagggcacttgccctatggccagaaacctcctggtcctgagccccatctctgcctctttcagtgtaagtgatgacgggcagctcacaggaactcactctgagtttcagctttcctcacctgtaagaggggataacaacagtcccacctggcggagctttgtgaggattaaaggagcctgaccagctgaagctgccggcaccaccaggcctggcccatagctcatgctcaggtcatgctaagctcctgctgctacatgaaggcagccagggagccgttgggcatacattttgggggccccttctggcctcgctccctctagtctgcatgcttcccttgcctgcagggaggaccagagaggggccttatgccagcaacagaaagggaagttcacatggcaactcggtcctactcttgttgtcttttcataaatcacacactcatagtcacagtcaaaaaataattacaattctaaaaactatatacaagcactttttaaaattaaggtaactcccaaatctcaccacccagaagcaaccactattaatatttagtgtgtaatttatagagcaggtggcttgtactatatatattatattgtatagtacactagcactatagagctagtgtgtaatttatagagcagcaggactctgtttggtgagtccattttttcttgaattttgaaatctctttgtcttttggcagggcacactcttcagccactgcccccgtggcccctgcagtctttcagtggacagttctccacatttctgtaacttgggtcgtaagatgttctagacgatatccttgaatgcccatccagacattgacctataaacaatagattggatattgtaatttataaaaaatggcctcatgctatgagcagtgcctccaaataattttgtcattggcaattatgaatacgcttccacatcaatggatctatatgggcaagccctcgtgatggttgttcagtgttctgtggtttagatgtaccatcacaaattaccctgttctcttactgctgacccttaaggtcattgtcagtgttttgctacgaaccatgcagccttgctctttaaagcatcccaagcattgtccatctctcccccatgatcccctagagtggtctcaggtagtgtgctttacagcaagcttcaaggacatatccctctttccctccctctctgcctctccctctccctccatccctctccctccgtccctctctccctccccctttccctccgtccctctctccctctccctctccctccatccctctctccctctccctccatccctctctccctctccctctccctccgtccctctctccctctccctctccctctgtccctctctccctctccctctccctccgtccctctctccctctccctccatccctctccctccatccctctccctctccctccatccctctccttctccctccatccctctctccctctccctccatccctctccctccatccctctccctctccctccatccctctctccctctccctctccctccatccctctctccctctccctccctctctccctctccctccatccctctctccttctccctccctctctgcctctccctctctctctccctctccctccattcctctctccctctccctccatccctctctccttctccctccctctctgcctctccctctctctctccctttccctccatccctctctccctctccctccatccctctctccctctccctctgcccctctctgccacccccctccctgcttctccctctccctccctctctccctgcttctccctctctctgcctccctctctctgcctctctctgtccctccctctccctctccctccctccctatctccttctccttctgttcctgtctgcctccccttcttcctccctccctctctgcctctgcctctccctctgtccctttctttattattccttctttctctttccccttcctcctcctctaaacaccagggcctcgctcactttcctctcctttacatgttgccacccccatgcttaactcagggccccttcccaccagctgcctgcagagcatgagaaagcccacccccttccctgtctcactgttctccacaccaacaaccccattggccatttaggcactttcctaccagtgacttcatgagcccagactggctaggagcatgccacgcattaagaagagaaagttccagaggccaaattcctgattcctcttccaaaagagctcacctaggagacttctgtggcctccatctccctgaaggcaggacccctataacaggacacctccagaaagatccccttgtggacccggagaccctctggcaccactatgcaatgattcctccctgtcatgggaagcagatgggatgaacagactgtcaatattttgtgttgttcataaacatgttacataaaactgtggatacttttcccagaagatgggctacatgttgccaggagaagcaagattacatggctgtaaattttctcttaaaagactctttgttaagagccgtatttgtttactttctccaattccattagggagtaatggggaaacttttccagaatggggtaagagtcatagttgcatgtctccatgggaaagtaatgaaaggtcctcgcacctccctccctgacacagcagccgccaggtacatagacagatgctcagcttcaaagccgagacatccaacactgtcatccacctgtgactaccaagaggacagcacaactcagcatcctgttggggcagcagaaacatcccacctcccagccaagagcaggaagcaggggggtcatagctgaatagccctaagcattgtagttaatcaaaaataagaggacagcgcttttaactcgtatctgtctcattgggactaaaagaatcaaagttagaacaaacacagagaggtgaatcagccttaattctggcaagatccaaagcctacactttatgtctcccttatctcatctttctcttaaccgggaaggagttttttctagcacgaaaggccaaaggcacagattgactgacccacccatgtggtccagccacaaatcaaagctgccgagatgcagacaggctgtttcatctctgagacctcgagccagggaaggttgacttcaggcgcttcctcacgagcttgcgcatgccagaatgaacagtgtagcttctgttggagtggatatgtggttagcttgcctagcccctcagtcagtttccaaagagattcataattctcagaaactgggcagccgccacagtgcggtgtcctgccaacggttaccataactctctccccttcttgccacccgagcctctgtcgtcctgaccaaggttggccatgttctttctttttttccgttttctttctttctttctttctttttttttttcagacagagtctcacactgccatccagactggagtgcaatggtgtgatctcggctcaatacaacctccgcctcctgggttcaagtgattctcctgactcagcctcccgagtagctgggattacaggtgcccaccaccacgcccggctaatttttttgtatttttagtagagacagggtttcactatgttggccaggctggtctcaaactcctgacgtcgtgatctgcctgcctcagcctcccaaagtgctgggattacaggcatgagccactgcgcccagctgtggccatgttctttctttggtaactttgttttcatttctaaagagctcgctttagtgtttttagttctaaagactatactatagaactttgggttctgaagttctgagactgcctcagtgttgaagagtcgtgtgaactcagcttcaagaggctgttctggtttgatattggcttggccacccaagctgttgatagttctcacctatcccattttcctccagaaaagttggaggataattccattgcctgtgagtactaaagcaataagtgtgtgcagaaagccgatcctcactcttcaaggaccacccccctttttttctgagggccaggaagttatccagaaatggaactgggattcagaagcagaaaacctgtgttcaagtcccaacacggccacatattggctattgatcttggatcacaccctcagtgttgctgagccttcattttcttgttttgagtttaataattctgatctctcagtgttgtgtggattacatctttatatatcatttggggaactgagaagtatgttcttctgctagcagttaatcacagaaattacaaattatatagagatgatacatagataaataaaaagtaaatacatagcagagattaaagaatatatagagatagatatatttagatagatatgtgtatttaaattttttcactgaagaatcataaagatacaagattcagatgcaataatgtttcaaaatccttttattgtcaaaattaagtgtagtttcacctgggttggtagcagaggtctatgtgattggaaaactaaatattaggaacttggaagtagctacatactgaaatgtgagcacaatgatctcttcatcagtgatttgtgatttaaactctatcttctatccacaaagagaacaagcagagatatatttattcataaggcaaaggtgtgtgtgttgcaatttcagagcactctgtgtagacagataccttaacccctttgttccaggtggtcctcagaagaatctttgtggagtggatgggacaggacaccatgcatcagtcatggtcagaagttaaccatatccttcctgtgctcccaggccagtgctcacgtctcctcctctgcctcttacttttgcagaggaagacagagacataatcagtcacagctgctggaagaggtcaccatagtgttctgggtctcttgcagcagcccagagggctaggtgtgaccagcttcaagttaaagacaagcaaactgaggcaaatagagtgtaagtcatccaaattccacagctggtgaatggcagagctgggacttgaatcagcattgtctggtccaaaggctttgaactttggactcatgttgctaaagaattccagcagttcctccctggggtgaaaggtgggcttagactgacctcacaggactatgggcacacatgcattctgggaaagaacccagtatctcagtgtctatggactgaatgtttgtgtccccttcaacccccacagcaaatttaaatgttgaagccctaatttgctaatcaccaatctgaaaaggtaggacctttagggagttaattaggtttagataaggtcatgaggatggggtcctcatgagagattactgcgcttataaaaaagacctcagaactgtgagaagtgttaattgtttaactcacctagtctgtggtattgttttttgttatagcagcctaaactaaggcacaagtgcatgtatctctttcatcacttgtaattttagaattccagctgatgctccctactgtacccagaaaacacacacagtggcttcccacggaatctcatagagaccctcagtgagccctcccccaatactgaagacagcttcctctgagataacagggtttattggctcctttatttattcatccaacatgtatggaataccaactgtgtgccaggcaccatgctaggcttggaggctccagagatgcctgtggcatggtctctagccatgagaagaaggtaattcatagtctagtcaaggagacagatatataactatcctattacccaagatggcttattctgcctaggacaagatggaaaatcatgagatccttcctaggagagttagacttgaagaacgagtaggattttgtcatggtactaaaggtagaagatgtttgagccagaggaaacatcaactatcaaggtaccaaagtgggaaggagaacaaggctgtcctcagccccagggaaaactgttgccacagatgccaggacacatatctcatttctttctctttcagacctggtgttttggggctttttatctcaaaatttcctcaaagtatgggttttgaaaaaaatccaggttcacatgatttgtcccagagttgacattttgtgatctaagtgagttgccttccattggttggacaccatcaatgttcattaatgtgccatcatcttgacagccagcctcaacttctaaaatatttatgaagcctgagatgggcccttatttacacactaaaatatttaactaccaaagatgaacaagatctgcaaagagtaggctgcagccctgggttcaaactggctccgttttgcaccaaagcactcttaaaaccagctattttgttagaaatcaaatattaatataaagggtgaataattcattggtaagtctgagttcccgagaagttccatcgaaatccccaagaggagattttggtgcagcagtgactatatatagactcagctctttccaccaagttcaaaatgagagatgctggctcagagcatgggctctttaactaggctacatgggttttcacccaactctcacttacttgctgtgccaaatgtcttctatttgtccctataaatcaccctctacccttcacactctgccctgtgctccaacaggctgaactctatggactgcagcaacaaataccgtggacctgtgccttccagttgttcaaccaatggaaagccctggcaaccactgcagaaactgagaagaaacaggctgagaaatgtgttttcccagctccctgtctccctgctggatcactatgggctcaaccaaaggccacatctcctctcaggtggactgtctacatggctccctctctaggctctagtaactactacctcctctcactccttcagacctagcagtgcctcagcttcctgggttactagccccagggtactgcaccatcacttgttgcttgccctaaactctggtcatacatttgcgttaagttcaaacttataaaattgctatttttgaaagtcaaaaatcaacaaatattggcagtctcatgtttcaacctcatatattgctcttttattaaacttgctttaatttgtatgtgttacctattttctacaacaaccttaactaatacaaaaggtatgtgactagttaatcgactttgcctcagtttcctcagtttgcctcagtttcctcatctataagatggagggaataatagtagaacctgctttagaaagttgttctaaggatcaagtaagctaatgtacacaagaagggtgtgtaaaacaatgtctggcaacaaaaacgtgctcagtaggtgttgtgggaagagatattcgagatagaaaaatcagaggaatgggtgtatggcttaataacagactgggcagaaagaaggtgacatcctctgcaacacccaaaggagaagaatataaataatttacatttatgtacattattctactgctcagaaaatttatgcctatgttctattttaaccacttaattaaaaatctattagatgcctactatattgctgctggtcgctatagaaatataacagagagcccatcagggaccctcatctacatatcctcatctcctgaaaagacacagacaaagaggctgaaaatgacattacagagtcctgtgaagtgcaatgatgagaaaagtcaaagatgacacagggagcactgaccacagatttggagagttacaagatggcttctcacagaaggaaatgtttcctctctgacttgaaggagaagtaggaattatccaggcacagggtccagacgatagaatagtattcccaagagagggaacagcattccagaaagctaagaaatgagagaatgtggaatatatagaggagtaaaagaagttgagtgtggctggctcagttccttgttgcctaagtcagtccctggtacacaataggtgctcaatgattaatgaagaaacagaaattacagacacatctctaatacattcacacaaggaagacaatattctccaagtggagtgatttgtctccccacatgtttattggaccttattgcttacctcacagaagaacaactccctgtacatgttgtgtagcccatttcctgcccacccaatcactcatctttcctttatcagaattcagaaacaaagatgcaaatctctggaggatctctggagctcaggaggcaagattaaaaggagagcaaactgctggaggccaggcctttgaggaagatcctttgaaggcaattcactcattcatccacttacttacttgttgatttatttattcactcattcaacagatactagttgagtgcctgctgtatgtgctggtagctggccagtgccacaccaataaacagtatagatacataacccattatcatggcaagctatgtctgtgagtataagcccaggtgattaggtagaatggccaggtagggtcagaaggagacaaccagtgcagactcttgcagactgttgtctttggctctgacagctaagggtaggttcctgtgggagtggcctttggtcagggagccagggtgaaacctacaactgaattgccagggcaatataaagcatcattatctagtgtaaaaaagcaaggaatctgaggtcaaaagatctgatttaactctgacttccccacttgctaactgtgcgactgaaaatgggttgcttcacctctgacatttagtcctcttttatgtgaaaaacgggaataatcacacaccccttgctgtgtagttgtgagaattaaataggatcaggtatgaaaagtgtatggcacatagaagtcactccacaaattgtagtttttaccattataaaaacagttttaatttcacttccattgaccacaaacccttattccattttggtgactggaaggagctctccatggtgctgatctattttgcagcagctgggagcctgccctgtgttaagaagaaaaacctttgtcaagaagaaaagtggcatccacagcaagatagaacacatatgtgttcccgaaaagatactccaccaaggatttctcccatactcactgctcacatggaagtaccatgcccaaattgcaagaagtaaaccaaaagaaagtaccagttatacaaagactattcttgaaaacatcactatgatgggaagcatcacagtgagaataataatagaaaagaaaaataagaataacatcacaatagtaggagtaatattaaacagcaagaggcaaaatgctatggtggttaagaatgcagtttccaaaggcaggactcttaactccaaatcccagctatgtagaccttcaatgagttactcaaattctctgagcttcctcatccacaagcagagacaaaatagttcctgcctcatagtgtcattgtaatgattaagttacatagtgtcatgattataattcctttatgccagacacaactctaactacctttcataccttaagtcaattaatgtaggattaattgacattaagtcaattaatgtatgaaaggtacttagagttgtgtctggcataaaggaaacactcaataagcattagctgttagcacggtagtaagaacttttagcacaattggtaagcagcgctgagggaagcattgtatgcacattatttcttagcacctcaacaacatgcagtgaccaattatcaacacagattgcatgtactacatgccaggcactgtcatacttccaggcaccctggtttcctcagctcctggcacagggccttccatacagtgaatgcttccagtacatgggagttaaaataaactgaatttatctgaattagaaagaaaatgccttcaaatccaaagctacttgccagcatagcccatgcacttaggaggaaaatgccacatagaaagtaaccaaaattctaccccccttctccccccaccaccaaccccctctggaagaggcagctgagactttctcactaaagaaattaatcctgccgagaaataaatccccaatgagcttcccaaggagacccttagcaaaccacggttagacactggcaggagtttcttcctgtggaagtcccattgagtcactgctgaattcttttctcctgtgcagcagtttgcctgagcctgagagatggccagcaattacaggagagtaaatatttcagcagtacagagtcagacttctcaacagccgataggaaaccgtttctctttcctttaaacagtttattaaaatacaaggttaaacccagcaagggaatacatttttctgcagcctcctccaattaacaagttatttccatgctgaagtttttcttgctttagcaaaacctctgcataaactgtaggaagagtgctttcccctcaggggaccatgggggttctgaacttggaatcaattagattccgagcccaactgtcctatgatttctctgggcaacctcaggcaaatcacttttcaactgcctgaattcaagttcaagaaaatggggacagcaacaccgacctgcttagctcctgtgagatggtaaagcatgtggacgtagctaacttgagagccagtgcactgaaggcaattggcgaactttgctgctacccaaaatccactcctcccttcttctcaccttttatccgcagccccaaggcatgaattctgaatgatacatgtcagtatgataaacctatttctctgccaggactggtttgagaacggatatagggcataatttattggccagtgagacatgaaggaaaatctgttggggagcttctggaaagggtgtcatcactttccaaagggatacctcaagaggaaggatgtaaatgtggtttgatgttttgtattactgaagtttggtgtctatctgtgatgtctggaagtgctgcagccatctcgtgactatgaggagataagcttgggaataaaagctaccataaaaaaatgacagaacataaagatggaaaagaccaggggctctgatgacacctgagtgtctgagttaaacaacactgactctaccctgcttttggatccactccaatttctggttatgcaaaatggttccttttttgtttaagccacttttaatggagccatctattacatgcagttgaaatcatcctaataagaacaccaatcaagaatgaaatatcagacttagggcatattttatcatggaaatgtcacctctctacccagctagccagtggccagcaaatctttaatgaacaccatgaacacctattatacatgcatagcttgcatgtctacaatgtaatataaagtaagataaagaaaaataccaggacacctttcctctcaaaagaaaaatgaacttcaagaaaatagggacagcaacacccacctgccattttatttatttatttatttgttttgagacagggtcttgctctgtcacccaggctgcagtgcagtggcacaaccatggcttactgcagcctcaacctcctgggctcaagcgatccttcccacctcagcttcccagatagctgagactacaggcatgcaccaccatacccagctaatttttaaaattttttgtagagatgggggcctcactctgttgtcagggctggtcttgaactcctaggctcaagagatcctcttgcttctgcctcccaacgtgctgggattacaggtgtaaaccactacacttggctcaagccattttatatctaagatacaaatcatagagatggtgacgatgatgagaatgaggatgatatttgtgcccattcaaattttaagttgcagacaacaggatctactctatctggtttaaatggaagaggaatttattaaagattgttaagagcttgcagaatctccaagagggccagagactggggcctggagaccacatgcccaggaacgatttccaaatcgcctgtttgcactgcttgtagctcacttggatctcatggcctctggctacaggccctgcagacgccaagcacaggacacagctgctgcatccttgggctctgccagaactgagatctggatgctgcctctgcctcatccttcaccatcctcatcaagaaaggattgcatgtggggtctgtgtttttatgtttccttcttccaaatcaaggccttgcatggatgcctctgatggcctgcatctaggcaacgttcttagaaatggctgggaaatcgacttctagcttacttgaagaggagagacttaaaaatgtgggaatttcccctaatataggaaaaatgttcagaaatgttaagtgatatgacaagtgttcattataccatctattcagtactttgatttagctggaaaacttttggacaagctgacagagggttggggagcaccaattttaggggtagtaagtggttgggtcaccaaactaaaaagctgaagatgcaggttcatatcttagctccatcactaaccaactgggaccaagcaactgcctggacaattgatgatgacctgacaagcacccctgaggctcaaatgagtcagccttctgcgtctggtgccgtgaactctcatgctccctgtcgagggcttggagacagggaagctgagtctcactcttgctttattggctaattggctgaatgaccttgagaatgccattcttgggccttagtctccacactttttaaatagtgggttgagctaggttgtgtctaggggttcttcctactccatttcttgtccctagaaagatgtcacatctgatgactctttaaagtacttctggttacggtagcaataattccccatttggtgttgtcccatttgtaggactcaccgaaaaacagcttgcccaagaaaatttgattttcaggcattagtaaacttgcaccaaatatttcccaaacttaaagtgaccaagaagtgttttgcaaacagagcaccacgtcaacaccttctaataatacagcaatctctccccaaagacatgccactgacctgtggcaggcagctgcccactgactcatccaccctcagaagacagatggctcggccttgaaggccagcctcggccagcctgtacatgatgagccactcacttccagcgtatccagggatgctctccacacaggctccaggcaactttatctttcaccctaggaaacccatgcactataaatacagcagtctctgtctctggtgaacccaactcccagcctttcacagacatatcacaaagactgacatctccattcccacactaacgagagagcacagactacacacactccacccgccatatccatctggtggctggaccatgtttcacttagctttcctgtttctgagcgcttgacaaggaacgtgagagtccatggctccagatgcaaaagactaactcctttgaatgatttttgaccatggacaagctcctatgtctctttctgagcctcagtttttctatctcgcaaatcagagttaaaaatatccaacacaaagaattagccagtgaacgtgtgtagaagcccctagcctggtgttgggcacttagcacgtgctcagtaaatgtagcttgcctttatttcttcaacgtcttcttagtatctggaacccactctctttttagggggtgctcccatgtgagtgtccacccctccgcatatgtggtcccgccttcagacctgtctcctggtgccttcaaggctccttccaggactaaacttccaggatcctcaccctgcctgtagtcagagcagtgacctgtccaatgagctaagcagatagttcaagctaattagtcaattatggcagcatgcatgatgtaaataatgaattacgagactgttcactgacaaaacattaacccgaaggaggtagtgctgtgggcccccatccacaggactcatggagcctgtaattccaatttatatatatatatctttctctctctgtgacacacacacacacacacacacacacacacacacagagttaggaggtcccagagagctggcatggtatcatttgtgtccttatgatgtctgtgaccagaagctgggctacttatgggtgagggtctgcatccaccaaaatgtcagtcagagggatgcacacaccatgagaaccaggaggctgagtccaggccactgccctgccctgacttgctgctgcaagattttggggaacaaccctcctcctcctgtcagctttcttttcatctcagtaacatagctgatgtccattgagcatgcggtatgagccagatgcttcactgggctccatgtgcatttgcacattcagtcatctctgtagccctgtgaaaagatctcatggccatccccattgacatgagaggaaactgaggcacagctccaggtcacacaactgctaagtgctaacttaggggtctgcatatatccaataccccatggctacacccccctacacacccatcataggcaactgaagactccaagaggagagagcgttctgttgactccagtcactggaaataaacacttttgcatgactgatatggttaggctttgtgtccctcacccaaatctcatcttgaattataatccccataatccccatgtgtcaagggagagaccaggtagaggtcattggatcatgggggcagtttcccatatgccattctcatgatagtgactgagttctcacaagatctgatggttttgtaactgctggtagttcctcctgcattcattctccttcctgccaccttctgaaaaaggtaccttgcttcttcttcaccttctgccatgattgtaagttttctgaggcttccccagccatgctgaactgtgagtcaattaaacctgcttccttaataaattacccagtctcagatagttctttttagcagtgtgaagatgaactaatacagtaaattggcactgcagagagtgggatactgctataaagatacccaaaaatttgggagtgactttggaactgggtaacaggcagagattggaacagtttggagggctcagaagacaggaagatgtgagaaaatttggaacttcctggagactggtttaattgatttgaccaaaatgcttatagtgatataaacagtgaagtccaggctgaggtggtctcagatggagatgaggagctgctttttgggaactggaataaaggtgattcttgctatgctttagcaaagaggctggtgacattttgcttctgccctagacatctgtggaactttgaacttgagagagatggtttagagcatttggcggaagaaatttctaagcagcaaagcattcaagaggcaatctgggtgctcttaaaagcattcagttttatggattcacaaaaggatggtttggaattgggacttatgtttaaaagggaagcagagcatgaaagttcagaaaatttgcagcctgatgacgtgattgaaaagaaaaacccattttctagggagaaattcaagccagctacagaaaattgcataaataatgaggagttaaatgttaatcaccaagacaatggggaaaatgtctccagggcatgtcagaggtcttcacaacagcccctcccatcacaggcccgaggcctaggaggaaaaaatggtttcctgggctggacccactgtcttgctactttgtgcagtcttgggacctggtgctctgcatcctagccatggctaaaagaggccaatgtacatctcaggcaattgcttcagagagtgcaagctcaaagccttggcagcttacacatggtgttgggcctgcaggtgcacagaaaccaagaattggggtttgggaacatccacctagatttcagagggtatatggaaatgcctggatgtccaggcagaagtttgctgcaggggtggagtccttatggggaacctctgctatgttcccctctgctaggaccccagaatggtagatccattgacagtttgcaccatgctcctggaaaagccacagacattcaatgccatcctgtgaatgcagctggaagaggagctataccctgcaaagccacagggttggagctgcccaaggccatgggagtgcacctcttgcatcagcatgatctggatgcaagacatgaagtcaaaggagatcattttggagctataaaaattaatgactgcccagctgggtttcggactggcatagcacctgtagcccctttgttttggctaatttctcccatttagaatggaacatttacccaatgcctgtaccactgttgtatcttggaagtaactaacttgcttttgattttacaggctcctaggaagaaggaacttgccctgtctcagatgagactttggacttggactttgggttaatgctgcattgaattaagactttgggggactgtggggaaggcatgattggttttgaaatgtgaaagtgacatgagacttgggaggggccagggacagaaaaatatggttaggctttgtgatcccacccaaatctcatcttgaattataattcccataattcccacatgtcaagggagagaccggttggaggtaaatggatcatgagggcagtttcccccatgctattcttgtgatagtgagtgagttatcatgagatctgatggttttataagtgtttggtagttcctcctgtgttcattctccttcctgcagccttctgaagaatgtgttttgcttccccttcaccttctgccatgattgttaatttcctgaggtctccccagccatgtggaactgtgagtcaattaaatctctttcctttataaattgctcagtctaaggcagttctttatagcagtgtaaaaaaagactaatacaatgacacaggtttagggaatcccttcctgaaagtgtcacctaaataaaaaagaagtgtgatcatcatggctttccacccacatctgccaggttttgccatggctacttggcagagagcttcagtgccactgctttgcagccagaggcacctgagcatcaatcctaactcaccatgctgcctttagacacaggcttttaccctatctgaggttcagtttccccatttgtatagtgggcctaattctctatgtcaatggcatccttggggaggatcaaacttcccagtgtggaaagggctgagcaaggggcctgcctcatagaagctactcagcagctactgccattgtggaaactgactggcccttgccagtcataaagcaggctcagccagttttctgacaaagggatggatttccttacagttttaaaggtgagttttgctctccaagactcccttctgttgggcccttctttcccctctacctcctcctctctttcccttacagaaagaaagccagtcatttaaaaaaaaaaggcaggaggaaaaatgccactcttggcatcctctggatgcctttcctatccactgccgttgtcatggtaacctaaagccatttgcctgcctctttcggctgtgccttctccactgaaagctgagtgtgtggctggccttttccctgccccctgaaagctacgtttagagttccccaatctattcttaaatttctccgcagctccccatcctccctgctttctctgcctcttacacttgagagtgagaaaggaccatatcaagcaggtgccccatggcattaactccacagatgtttaagcagacctcctgtgtgcaggcactgtgccagatagaaatttgtcagtgccaaaatgcatgaagagaaccaatcattttatcctggagaaactgaggcccagagatggaaggaggagagcctgtctcagagccccatgtcctcatgcccaggtgagtgctgagcttttgtttgttgtcattagcctttgccaatgaccagcctcatgtgggccccaagctttccatctgcaagtgccatgaaactgtggagccatgggcagagctggccagttttcccaagattcctctttcctctggtgcagctggggggttagggcccagacctctttatgaatgtccttttagcacagctaaggcagatcttccccgaccatggccctatccgctgcagcagacttccaggagtgcatggaagctcctgcttctcccaccctgccttgctccttaccatgggcagagctggagagagtgtggctacagctagctttgctccacttaacctgccagctccatctgcaagctgacgtcacctgagccaccactattccccccacccccaccctggcattttctgcttattaaaacacacatgccatctccgctcctgcaccattaaaacatttgctcggcagcccagactcggaaaagggagggatggagggagggagtccacacactgtagaaataaattaatgtggaataaaacagcagtcctggctcccataaggtggctggtttgagaggcagatagatgctaaaaggctctagttactaaataaggaacacttaaaataagcacccattgctaatagctcacccttaaaagagagaatatgacaaagactgcacgaagaccaactatgggtcagcactccatcgtcttcatcatgacgacatgtacacagtacttactatgtgtcaggtgcttgaccacactcgctaaatctagttttcatttatacatccattatactttcttccatctccaccctctgctcccttctctcactttctgctccccacaggtaatccttttttattctttttgttggtccgtttcagattcaccatatctatagataatctatttattagggtgactgacttggaggctttctctattgacttcctactatggaatttaaccctctttccttagctcctatatccaccacagacacttcctgccttcatccttccaacagggtcatgtggtcattttatttagatcagcagctttgcatgatcatgactatgtgaatattctacctagataagccatgtagtgtggtgtggtggccacaaaatgcacccctccagtgtctttctgaagggagtataatagactaacagctcagctgctgcccctctgggcccatcattaccttcacaacaaggccacatccctgtggcccagtgactgagcacaggtccattcctgcaagacatgcaacttctccaattggcctcttgggttggagactcccctgttgtcctggctgctcctttctggaaattgcattgcagcctgggctgtccccacctcatcttcctcccttccctccctcctgcacaggggccagccctgcactgacttctacaagtgccgctgcctgtgtctgggctttcccactagatccttcaaaggtgtttcccccaatcaatctctccaacatctaatcccatcttagtgtcattcttatcaaacctgtactcatatatctggagtcaatcattgtccctctctcataccctgtttatttagttttttatttgtctgtttgttcatgggctttatgtatgatagctaaaagctgaaaataaacaaatgaatggataaattaatagtggcatattcaaacatcagaagagtactcagaaaaagaaaaggctgaactactcatacattattaataaatctcaaagtaattacacaagacaaataaaaccagaaaataagaggagtaaacactttatgatccaatcatataaaattccagaaaaggtaaacatatatattatagggcaaaataaataaatggttacctggacgcctgggaaggatgaggagagggattataaaaggacatggtttcacagcttcatctgtatgtcagaatttgtccaattgtgtatgtcaaatatgtgcagtttataacatgtaaattataccttaataaagctttaaaaattggttcaagataaaaatctacatatcccactctcaggttgtttgtttcgttttttatgtgcttatcactattctattctgaactctcctggtatgtaaatcttctcccaatgtgtgcagacacactaggcagtctcacaattgcactgcatcttacagaaacttctcctggctccttctgaccttttccaatctgggctgggctctctccacctgctgtgcagctgacctcttgggattttccttactatcatctgggggtcttcctctgttgcaccccctctttcctgtttttcatgcctggatctcctttgactcaccctcatcttgctgtagcacatcctccagtagtttcccactgaagggtgggattacgcctgtaatcccagcactttgagaggctgaagtgggtagattgcttgaacccaggagttcaaaaccagcctgggaaacatagcaagaccttgtctctacaaaaaaaaaaaaaaaagaataaatctgaaagtaagatggaaattctaaacctgtctttcatctatcctcacactttagcaagagtctggctggacacaaaattctagatggaatcattttccttcagagtctggaaggctctgctcccctgtcttttgtgtcatgcagtgctggagttcacaagccttttctccctttggaaagaaaatggaattcctccttcccccccgcatcctgaaagctcatggccatgtgcctcctgtgggtgggtctgttgtcctcccttgctctgtgctcagtgagtttttccagaccagcaacttggctccttcagttccaggaaagcaacttgaattctttatgggtgaattcttcctttctctttcttctcttctccttctttgcagctgcttttacttggatattgaatgtcctaatctggtcctcacatcttctcatcatttagctcccattttctcatctctttgtctctcactgtactttccatgagatttttcaactttatctggctacttttctttttttttctttttttgagacagggtctcactttgccacctgggctagagtgtggtggcacaatcaatgctcactgctcactgcagcctcaatctcccaagctcaggtgattctcctacttcaacctcccaagtacctgggactacaggcatacaccaccacgcctggctaatttttttttttttttttttttgcagagacagggtcttgctatgttgctcaggctggtcttaaacttctgggctcaagtgatctgcccaccttaacctctcatagtgctgggattacaggcaaaagccactgtttctggtctatcttgctaccttttaattgattttttaaatttctgctatcttttttttaattttcaagattttttttggtcttggaatagtcctttttatagcatattctttttttttgaagcattcttctctataaaagaatatattaataatattaattgttaagaatagtaagaataatgtacgtgaagttcagtctaccggaatagcttctgcttctttcaagtcgcttttttttttttttttttttttttgagacagagtcttgctctgttgcccaggctggagtgcagtggtgcaatctacaggcatgtgccaccacgctggctaatttttttgtagttttactagagacgggtttcaccatgttggtcaggctggtcttgaactcctaacctcaaataatctgcccatctcggcctcccacagtgctgggattacagtcaagtagctttttgtttgttttgatagcttttgtgttaagtgcattcccaacatgtcttagctgttcagtagtatttacaactagttattgagaaggtaactagctatctgggcaaggtggctgggggagcttgttatctgtagttatgttgggtgatctgactgactatttccttaggcaattccagatcttggtatctttgacacttttctttttagttagtgaaatttcctacaaaagactcctaatctctttctggatgtcaatagactgtgcagaattcattgtccatgatcagcattttcaacttttagcagagtccagcgctcttccagagcagaccctatttacaaccccctcctctatacgaaaaaattattcccagtaataatcatgtaagaatcagcattaatcacttctttatttcttctttagttttaaaacaaactgttaacataacagatggataaattttcattttaattatattatgcagattcagtaaagtattttatgtaagaactaaaatctgcatttgccaaaccaaagtactgcactcagttcacactctgatttactgatttaaattttaagcattcatgaaattccaagcagtcacatggaatgccaagcgtgaaataatgcaaattctacttctttgtctttgcattcacaatctctcattgttgcaatcttctttacaaatgcaggaatttgccgcaccccagggattggacccaggtcacaaccaaggaagctgcacaagatctgaagtgttagccatctcctctcaaccaaatgcatgtgctgagtcctcatatgctggggttcttgcaaataacttccatgtagaataaaatgcttattaaagggtcagtaataaaatgtgctgttttgaagcgtacatctatacatacttttttattttttgaaaaagggttttgctgtgtcactcaggctggagtgcagtagcccaatcatggctcactgcagcctcaaactcctgatttctagtcatcctcccacctcagccgcctgagcagctgggactacagacatgtgccaccaagcccagctattttattttatttatttatttattttgtaaagataggggtctcgctatgttgaccaagctagtcttgaactcctgggctcaagcaatcctcccaccttagcctctcaaagtggtggcattacaggtgtgagtgtgcccagctgacatctgtattattgaaactcaagagtaaccacacagttatttagaatatagaccaacaagatatttttcagggaggaatactttatcacaatattgttcagaattaccagcacatggtgataataaaaaaacttggctttttattgttgtaaaatgtacataacataaaatttatcattataaccatttctgtttctggagatgaagttttgttctgttcttcagactcgagttcagtggtgcaatcatagctcactgcaactccaaattcctgggcacaagtgatcttcctgcctcacccccctgagtagctgggactacaggcatatgccaccactttcagctaatttattttttgttttttatttttattttttttgacaaagtctcactccattgcccaggctggagtgcagtggcacaatcttggctcactgcaacctctgcctcctgggttcaagcaattctcctgcctcagccttctgtgtagctgggattacaggcgcacgccaccatgcctggctaattttttttttctttttttttttgtatttttagtagagacagggtttcacaccatgttggccaggctggtctcgaactcctgacctcatggtctgcctgcctggggctcccaaaatgctgggattacagacatgagccaccgcacctggccaatatttttattttttgtagagacaggatcttactttgttgctttggctggtctcaaacccctggcgcctagttatcctcccatctctgcttcccaaagtgctgggattacgggcattttcaccatttttaagtgtacagttcagtggctctaagtacattcatactgcggtgaatcaccaccatcgatctccagaactttttcttcattgcaaacaaaaccctgtacccattaatacactaactcccccttttcatctctccctagttcctgataacctcctctctactttctgtctctacaattttgactactctaggtatctcacataagtggaatcctacactatctgtccttttgtgactggcttgtttcacttagcgtaattcttcaaggttcatccatgtcgcagcatgtgtcagaatatccttcctttttaaggctgaataataacccgttttatgtgtacaccacttgtatgtgtacaccacattttatttatgggctcttgggttgctcccattcctggctattgtgagtaaccactactatgcacataggtatacaaatatctctgtgaatccctgcttccacgtctttcgggtatatacccaaaagtagaatttctgtactatatagtaatcctatgtttaattgtttgaggagtcaccatgttcttttccacagcagttgcagcattttacattcccaccagcaatgcacaaggattctgatttctccatgtccttgctaacacttgttattttctgtattttttttttttttttttgagacggagtctcgctctgtcacccaggctggagtgcagtggcaacaatctcggcacactgcaagctctgccttccgggttcatgtcattctcctgcctcagcctcccgagtagctgggactataggcatccgccaccacgcccggctaattttttgtatttttattagagatggggtttcaccatgttagccaggatggtctcgatctcctgacctcatgatccgcccgcctcagcctcccaaagtgctgggattacaggcgtgagccaccgcgcccagcttctgtattttttttttttttttaaataatagccagcctagtgagtgtgaagcgacacactgacttttcaccagttgtataatttttgggaagttctctacagacaaaatgtgactttgctacctccacccaagacagacccttccactgactgcccttggtacttctcgggcctccaggatgtagcgttttccagcattgtgcccttggtaccccaagcccagagcctctctctttatcttctcccgggaataaggttcccacccctctgctggagtgggaaaggggcatgcccagtagcatgaagtggctgaggaagctggaagtctaactgctttttgaactttcaaccaatccttctgtttctagccccaaatcacttccacttccaaaactaccgtgccaccaggtccagagcctgtaaggcgttcggtgatgctcatccattgcttctcatccccattttgacttaggatttaatgcctccaatctgctcagtcagttaccacgcatccatctgctttccagcctgcaattgcagattccacatctgctgctccctcctctccttctctctttggccttaagggtctaagccttcttaaaaattcctttgttgtcatttggatggggtttcaggaaggagtaaagctaaaaacatgtgttcaatctttcatcttcaaaaagcctcaactaaagtttaatatgcattactttacttaaattgtactattataaatgaaattaaacatgaggatctgagctgtggtagaggtggaggggcatgtggaagttcagggagggcccccagtgcagcaaagggtatctccaaaagctcctcaaggaggtaacatatgagcacatgaactgagctgtgaaggcagagtaggagtttgattcattttacacctgttctgtgctgagaacagaagcataaagttttaataattcattgtccatctacccaaactaacacttagctgctctcaccatgtgccagaccccaggaaaatgctggtgagtcctcagcacatgcaaccagccccggggtctcccctgtatccttggctctccgaaactgccccacccagaagccatctgctttctatgatctggcatcacctcaccctacttccaaatgctggtaaatctcccagcctcacctaaacgttcaagcagcctatctgtaacccaatctttgtgaaattgttggaaagtccctccctccttctccaagaatggaaggttacataaaggtcgtgcagaagaacttggatgaaacagagagattgtgcagaattcattgttgatggcagccaggctggggacagataatcctagggaaagcatcagaactgacttgaatctctgcccacagagaggggatccagaattcagagtatgaccttgaacaaaatttcagtctgctcctggactgaagaccaacagcacataattaattggaagtgaggtccttatgagtgacaggttggcagtgattaattatcttaatatttgctctgggttctgaggatgtgcaaagtgattaaagaggggttttggaaacagtgacttgtttgttctctgtcccctaattgtttgctaaatgattcaccataattacatgtaacgtctccctgctcccccaggtaatacttgcataatatggaaacaaaactgaaatttctaaagtacaaacacagcaaggtctggggggtgggctgagaagctccagaaggcatcatgtatgggacctgataatccaagcctccgatcttgtacattgctccaatttgtagacacctgaattgtagctcacgcagagctgtggagcagtattgtttcacagcaggatatggagggggtgattaagaggtgagattggggttaggcaaggagttaacctcagtgccatcaggagactgaagttctaaacctactgttgccacttcgtgtgcaggaaaataatctgaggcacagagaatcagattgagccatcatgggtcttcctaagctgaatgctctgatccaaccccagcctcctcagcctcaggcccccaggcttctctgcacaaacaggagaaacaagtcctggacctgccgtcctcttctgatgggcaaggggagagccaccacctctcactcaccctccagcgcccacctcttgcccatcccagccattaggatgcttggctaagaagagatcagctgattggggtggggagtatcagggagcatcgagatagatgttggggcttccaaattcccagaaacccccatcctgatttcagcactcctttaccagtcagtaccaaggacagcgactattgcttctggttccagaaaacacaatacaaagattcaaaggtatgagatccaggagggcctgagaggtggtgaagtctagcctgtccccttacaggtgaggacacaggcccagagatcagagggtattttccagcaccaagctaagcccaggtactcaggcaggcaggatctcatgattcacactgcgtgctgcacctgggatgctgccacgctgcctggactctgggctccttggaggaaggggctggacataactcatctgtgtccccacaacccagtccagggccaagcacagaggagatgcttagcgtacacgggtttaacttatctgtaaatccaaatcctcccaggcacatccccataggcccaggccaaggaacacctcccctgggaagaccaccttgtcaatggtggagaaagtgcctgcagcttagagctggtatcaccatttcacatgagcaaaccttctgtgtgttattgctgctttcttcccaactataataaattgtctcctcaataaacctgagaattactaattcatattctctgaatctttaataatgcctggcatagatatttgtaggatacctgcatgaaatactgtcccaatagagagagagagagagagagagaagaggaggagatagttagagggacagagacttagagaggcagagacatttttaaagaaacaagaagaacactatgcatcactgtgtcacaactattgttcagtggcccccaaagcccaagaggacccatttaagcaagtagggatcaccagtgagatttcagacttgcttcctttagttcgatccagaagagaaaataaatattatgactcattgttggtttaaaatgagctttcctaccctcaaacacaaaacaaacgtggattctattcatcttccctccagcctacactctgggcaacacctttgcatgcacacatcagccactgtctgtcacttccccatggcgggggagcatgctgctcagtaaggcttcacagcagaaagcttatatcagatttgcagaatcaggtgagtgaatcacagacaaggcccctgggccttccgcacaaaccagctacttggtggaaacgggcaagggttgacaaactgaaggatgatagagtcagaagagaggatccttcagctatgttgaagagactccttcctagatggtcaaataaggatcttcagactccagataggaagtgtggttttgtaacacgctaatctgactgtatttggttactattgaagaccaccatggctctactttgctcacaaaagctgcttaacctgaatagcagggcaccaaggttggggtcattccatgaatgtggtctttgcttctaccccgccctttgctctagcaccacccactgctcagctagtcacacacaaggtggccctctagggggactcgtccctcctaggaatgcctttctaccctcccctccctagttctgcaattagctggggactcccaggcatttttaggaccccaggctgagcaagctgtcattcctctgtgccccagaggcaggccctctgtggctctccatcagctcctgtattacagtgacttttttactcccaccaccacactgtgtacctttgaggacagagtctgtgtggtggacactggctgactgccaaatacccactgcgattccccatgcctcccgctatacagcagaatgagacctgagaaacagactccagtctggggattgggacgtgttagtccaagctattgtggcaacctcatccccttgggcagtgactggtcttgagcccagggctaagccagtcagtgtgtggtggtgccctggagatgctgttggtcaggggcaatacaggcacaagagctgctccagtcagaaggaagattgggctttttctgtagagttagtgaggaagaactcttttttctcaactggccacgaatgaggaactctcttctctccacattggcccaatggctccttgaccatgagggaatccagccccagtgtgtgtccagcattgtggatgccagaggacaggatgggagaacctgcatccttgttggcaccatagagcctctgggtccttcatttgccctctgagtttctgacactgctaagaagtgcatttccagcgtcagccagtcaggactgagttacctgtcactcatagttgaaactccagaactgatatagttggtctcagtcacctttgtgtgtcagtgctcagaagcatgtgagaaagagtagatgctcaaatacgagagtgtcagcattgggtgctcaattcctgttgctggttaggaaaagaatcaatgaggaggaggaaagaagcttgctgagggcagtgagaccatcaaccaccagattgggatgcatcaagggcaggtaatgacaaccacctatgcagattccacagtggagccagcacccaccctaggtctctgtggctccagtgcctggcttatctctaccatctgtcctgcctggtgacctcagacccaaagaaggcattactggatgtattgtgtattccatattcaagatattttatcagaaaatgctttaaaggtgcatttaaatactggtcaaacaatattattttatattctttctttttacatcagcatcacataaaaatataaattcttttatcttaacccagcaaccagtcatatctctccagggcctctgctgatcattatcaatgtgtcaacattgttttgctgtctttgtaatccatatatattcctgcttcctacgtttttttagttaactctttcattgacaggtagcaaagtagcaaaggaccttgtctgcgtaatcatcatatttatcattttaaacatctgtaccccattccatcatactaatagcttgattttgcagtctccagtggttgggcctgaggactgtatctgctttcgctggaatagtcattggagtaatacagcatactggtaaacagtgactgcccttcagatgttaacagccagtgggtagaatgcaaagtagggatcccgggtcaccaccactcatcagtttcaatcagggtgcattagtttgcaagggactgaaactcactcaagctgccatgagccaggagttcagtagggacagagcaaaatatctgggaaccacaaaacagccaggcctcagggaactgctaagaaccatctctacagtttttctgtgtcaccctgtctctgtctctgtgtctctgtctctttgtgtctctctgtctccagatgaatctccacaaccaccagacctcaaatccccactgacctgctggtccagggcccatcaccaaccaacccagggctgaaattctcagaggactgtgcatgtctgtggccagtgggggctgggggaagggtgtcatgtgccataacctacacactgacttctgtctctttggccaggactaaaggtgagcagctttcagacaaaggggttctgggggagggaagccacatgcacctcctccactctggcacttctattattaatacatcacagaaaaacactttataaattttaaaattcccttcagtgcaaatttccctttaaaggcaggcctcctgtatttgaatctgagtccaccacccaccactctctgattttgggcaagtcatgccccacaccttttgtgctccctgttcctaggtgtactcaagtcaacaaatgagggaagagagagaccctttcatattgttttatactcagtacctgtttaaagaaaaaaaacaaggaagtgaaatcaaaaacaggcagcctggtgccaggcccaaaactggacctgggcctgcctggcctaaacctagtagttaaaaatcaactgatgacttagaaaccgatgttattcatagattccagacattgtatagaagaacactgtgaaactccctgccctgttctgtttctctctgaccaccagtgcgtgcagcccctgtcatgtaccgcctgcttgctcaaatcagtcacgaccctttcatgtgaaatcgttagtgttgtgagcccttaaaagggacagaaattgtgcacttgggaagcttggattttaaggcagtagcttgccgatgctcacagctgaataaagcccttccttctataggtcggtgtctgagaggttttatctgtggctcgtcctgctacacaaacactgactgcctgttgttagctgacattaattgagcatttactctatgccaagcgtggttgtaagcactttccatgagttaactcagggaatcttcacagcctcctaagatgagaaatctgaggcacaaaaaggataagtaagtacttgtggattggacagctagtgtttagtatgcaaagaaatgcaaatcaaattaagataccactttgcattcaccagattggcaaaatgagaaagttgagtgacactaagtgtgggcttggatatgagcaaagcggagctctcctgcaatgctgatgcgtgtgaacttggaaccgcctttctgaagggcatccaggttgtgtttatactggaagtattcgtgttcaacgacccagcactatcaccttcacgttccaattccagagaaactctccagggctacccaaggaggcatattcaaagatgttcatcactctgttgtttacagtagcagaggactgaaagtgacataatctaggcttccccgactaggggaatggaaaagaaaaggtacaatacacatctacatagctgtcagcttgatttcaaaaccagaatgaggagtgaaaactgtgaagaaaatagaattattattgtgaaaggaaaatatcttgggctccttcaagctgggaactgctcagggcaaatgtgcctcccattcttttcaaaatcaccccctgctcactgagatagatgcatatctgatggcctcctttggaaaggctaatgagaaactcagaagtattcaaccttttgtccctcacctacctgtgacctggaagccccctcccttcttctagtcttcctgccttcaagttgtcctgcatttccagactaagccaatgtacttcttacatatattgattgatgtctcatgtcaccctaaaacgtataaaactaagctgtgccccgaccatcttggacgcagcttaggcctgaggccatgtcatgggcactcatccgcgaccttggcaaaataaactttctaaattaactgagactgtctcaaattttgggggtttacattatccatattgtaaactgttagggaaaaacccacccaaaaaagcttcttggcactgccaacacccctccccttcccccaagcctttttacatttctaagcccttatctaggcgccatggtgaagcctgcagactttacctatcaggccttactgcgataaagcaaaccccaattacaaaccatctggaccaaacggagagggggaggtcgtaggaagcataaacaaactttaccctcctgtaagttcctgctatcataaacatcaccaggtgatatgtggcagagttaacaaacaaacgaccccagggtctctctcccccatataaaactcctcattttgtaagctcaaggctgcctcctctgtaatggagcagctggcaggttcaataaacttagttgcctgaacttgggtctctctctctctctcttcctttctcttggctgaccttacataaacaatatgcgtatatatccaaaataattacatatatattaaatatatatgtgtgtatatatgttcctcaaattgtgtaattttcttgagacatgtgagtaaatcaatgtttggcaggacacacagtacgtgagaatggaggtgaatggaaggagaggacaattgattgggaataaggatagagagaatgaaattgaaataaaatgaaataaaaccctaagaactcagcttctcaggtaatttagtttggatgtctgtcccctccaaatctcatgttgaaatgtgatccccagtgttggaagtggggcctggtggcaggtgtttgggtcatggggcaggatcccttctgaatggcttggtgctgaccttgccattgtgagtgagttcttgtgagagatcagggtgtttaaaagcatatggcacctcccccatctctctcttgctcttgctctggccacgtgacatactggcttcacttcaacttccaccatgattgtgagcttcctgaggcctccccatgccagcaccattcttcccatacagcctgaagaaccatcagccaattaaacctcttttctttataaattacccagcctcaggtatttctttacagcaatgtaaaaatggcctaatacaccagggcttctgagaattaacctgtcaggtgcagagaactactgcagacaccagatcggtctttctgaactgcgagataaggactagatacaacatcagtatctccaggcccctgccttccacatcccatggtgagtgccctctgcaagaggcatctctaaatctgcctcctgtgcttgggtgttgcatcaggtattcttggtacttttatctacgtttggtaattggacaattcaacaaacacttaaaattctatgcaactattgcgactcttgttcaataaccaaacatgggtaaaagtaccgagaatacctctactataaagacacatgcacacgtatgtttattgcagcactgttcacaatagcaaagacttggaaccaacctaaatgtccgtcaatgatagactggataaagaaaatgtggcacatatacaccatggaatactatgcagccataaaaaaggatgaattcatgtcctttgcagggacatggatgaagctggaaaccatcattctcagcaaactaacacaggaacagaaaaccaaacaccaaatgttctcactcataagtaggagttgaacaatgagaacacatggacacagggaggggaacatcacacactggggcctgttggggcatggggggctaggggaggtataacattaggagaaatacctaatgtagatgatgggttgatgggtgcagcaaaccaccatagcacgtgtatacctatgtaacaaacctgtatcccagaacttaaagtataataataataataataataataataataactgaaataaataaataacactctgcttgctactttacaaaaagatgaaaactcattttttcatattttatgtctcccccagcaggtctggtggagaatggagagctcaggggaaaatgggactgattgaaagagactctctggagggttttgtgctgcacgtacccagggggcccgaccaccatgagaaacactctgttcataatgcagcctgttccctccccttcaaggcaaagcacagccctggccctggctccacagtgtcctgacagcacagacagcacctggtccatcccccacagcacagctgatggaagctgaggcctggagaggaaatgtgggttgttgggttgagtggtgccctccccaaaaaatggtatgtccacttgcaacatgtgaatgtgactttatcggaaaaagatctttgaagatgtaattaaggatcttgagatgtgatcatccaggattaggttggtacctaaatccaatgataagtgtccctagaagagaaggcgcagaggagaggagtggcactgaggggaaagccatgtaaagaaagagatggaggctgggtgcggtggctcacacctgtaatcccagccctttgggaggcccgggtgggtggatcacgaggtcaggaatttgagaccagcctggacaacatagtgaaaccccgtctctactaaaaatataaaaattagctgcgcgtggtggcaggtgcctgtaatcctgactactcgagaggctgaggcaggagaattgcttgaacccgggaagaggaggttgcagtgagcagagatagcaccatggcactccagcctgggtgacgagtgacagtctgtctcaaaaaagaaaagaaaagaaagagatggaaattggatcctgcaagccacggaaggccagggactgcccatggccaccagaagctggaagaggaatgggggtccactccctccaggctgccaggaggaaccagccctgctgactccttgattttgagtttccaccctcctgactgtaaagaatatgtttctgttgtttgaggccattcagtttgtgaattaggagaccaatacaagtttctactcagcaaacagttgtgaccacctcctgtcctttgtgccagaagctggtaattccagctaaccaaagcaagggcctgaccacaaagagtgctcaaattaggagtgtgagtcagatgcaagagtggcagacagagcaagagccctggggcttggcccaacccagagagcccaagatggcttctaagaggaggtgatgcctgggcaggaagagaattccaggcagagataataagagccaaaataaggtatctgagggagctgcaggctgcttggtgttgctaaaaattaaagtccattgcatcaggaatcaaggggagaagtgatgggagatggggcatagccaagtcccttcctcagcacagctcactatgactgaggactggacatgggtggccctcatgggcagatccatccagagcgctacagggaagagatccttgctcctggcttcctttctgtgatgcagacattagaggggggtggctgtcatgtcaccagaccagcatccagcccacaggctgtctgccccatgcccatgtcccccctgctgtctaagctttgtgaggctagcaaacccagggtctcattgttcactccttacttaatgtagcttctcatccagggtttgtggaatggatgaacactttctgaggattaaatagtatgctgcgttaaacacttctgaatgccagtgtgttagctgtgaattgcttgttcattattacaagctcctcatgggaactttgaaactagcccgacatgacaaagccatccggaacaagcagcctttagcatgggctcctacactttgggacagtgtttcccaaaacctggtctgtagaccctctgcatcagaacctcctgacaccggccaggaggcacaaattcaagcactggccctggccttctgactcagactctctgtgggtgggacctgggtgctggcatatcgaacagcccccaggataccctgtgcgtgctgaagtttcaggacctggcaggagaatcctcagaaaaagggaagacagcttctggctactgcttctattcggcactgctgccttgacagggcaggcaagccacacaccaggaaatgggctatttgaccccacggttggcctccaccagggtgacagctattgaagaaaagttgagtggaggactagcagagagggtgactgtccatcctggtctgctcgagactgagggggttcctgggatgcaggagtttcagtgccaaagccaggaaggtcctgggtaagcctaggggggctcttcacctgccttcctgcagcccagcctcaaggagcatctctggggctcactgttactcacctgcagacaggaaagagatcctggagccctcccatttccactagatccttggtatcccctgcgcctctgggagctgatgagtttgatatggcagctctacagtgagaggacgaagcttaagaagcaactttcacagagaagtaaaaggaactgtgataattttgaccctgtaaacttgtgaagggacagtctgaagtgtttcccttacaaacacttttctctttcaagatgtggcccccagaacttaaagaggctttatgctaggagagaaagctttcaagcacaagctcttatcacaaagcatttgccttcccctcagggcaaagggcatgtgagcatgcacacacacatacagacacccacacacaggcacatacacacagccattagagttgattcatcaacgtccacactaaagctgcccattctagctgcttctattgtaacggtttcttcaaacaatagctttccactcctaatactaataattacagctgttatttatggagtactcattgtgctgggcactgacgcgtttcccatgcactatggcattgcctggcatttcattctggagccatccccattttgcggatgagtaccccaaggtacagaaaggctaaataactctctccagtttatacagagggcagatggtgaagcccgaattcaaagcctgtgttcttaatgaccacaccagtggttctcttgagggggtctcagaattgcctgggggtcttgtggaaacatggattgctggccccacccccctagagctcctgactcagtagtctgggtagggtcagggaatttgcatttctaacaagttcccagatgatgctgatgctgccggtcctgggaccacactttgagaaccagtgcacgataccatattgccttcattaagccagaagggctgctatgtaagagcaacaacaataatcataattaaaaatgaatgttctgcagtgcttattaggttccagccagtattagaagtgctttaaatacattagctcgtttcatcctcacacccacactccatgatggagagatggttattaccgtcatttcacatgtgaagacattgacagcggagaagctgagtaacttgccaaaggccacacagccaataagtagcgaagatgaaatgccatctacctggttccatattaaattgatcaataattacctgtggtggattcagacctcatcctgacttgacttgacctgccccacccttttccaaccagttcccttatagtgtcttctattcatgtgattttatgtactcaacataaagcagccatgttttttttccctgggcgagcccagcctctgaaaactggagtgtgcatggcgtggacccatgggttccctgtttaaacagacagatccctagaacaatgcaggatagggcatgaactcatgactatggaataatttatcagaaaaaaatctccctagaatagtgattcttaacctttcgtggggtacagtctcttctgagaccctgacgaaaatagtaaccctcttcccaggaagacacacatgtccatatacacccgagatgttgcatccaatgctaaggcagttatgaatcttctaaaaccattcacagtctgtatgcccccaggtagggctctgcctcagaaagcaaagaacaaaaagccagggcaagtggtttccccaagttcagcccctccttccatgaatgcagctttcatcacgtggatcgtatggtcttaaagtacccctctgcctgcaaagcagtgtctgacccttagcctgccaagcaaggtgctcctacctgggaaacagtaccccactcctgcagcttcacctcaggaggctctcaggctaccctcaggccccaaagacagttgaatttccactggtctttgaagtgttctgttaaaaatgcaaatactataggaagggatcactgaccacagctggccctaatacaaatgcaaagtgttatgaaatgttatgagctttaagatcttgaagctgattataaggagaaaacaggcacctgcttaattgtagttgtcttgggcctctgtgaatgatgctgcaacagacatctttgtccatacggaaactgccttagcaaagattatgacagcaagggagtctagcacagctgactctatcttgcttctagcctcacaggctggctgtcctcgctcattcctgggcataagccaagctaactgtaggaggaatttagtttatggtttagctttgaaacaagcatgatcatagtccctctctaaaactgatcccctgcttgtttggggcctgaaactgcttttgtaagactaaagaaaggccacaagattatgattatgggaggggcctgaattctgctaaaatgtaggcatactttctgtaatcccttactgctctggagtcatgtagccagaggtcacaagatttgtggctgccccaattgctcctataaataacatcactattgtagaatctaagattggcctttggagatgtttttcagacttctgaattctggcatccgactgaccccacctggactcgtgactcatgactcagttggtcctgtggctccaccaataggcaggctcagcacatgaggaccgtcttccacacccctatgattgtgtccccaaccaatcagtagcacccattccctagtcccttgcccaccaaactgtcctggaaaaaccctaacctccaaacctagggggagaatgatttgagtaataactccatcttctgcatggctggtgtagcatcagttaaactctttctttactgcgataccatgatccaagtgaactgtttttgtctgtgcagcaggcaggaagaacatgttggacaattacaatatgagagtacatgccagcagtttcatttctatggaatatatcccaggaatgggattgctaggtcaaggttgatttgaatttttaatgttaacagttgttagcagattactttcctgaaagattctaaccattcacacttccattcacagtgcaggagagagctttttggcctacatggcctctggcaatatttatcactctcttagatttttgtcaggctctagggtagaaagtgatacaccattgcgactataatgcttatgtagtatttaagctcttttcttaactgctagagaattttaatataattcttggccatttgaatttgctgttgtatacattgcttcttcataatagcctgccctttttttctcttgtgttgcttgttttcatcaaattttaaagcactgaatacatcatacacatatatgtacacatatacatatacatattttaaagcactgaatacatcatacatatatgtacacatatacaatacatgtatatacatatacatgtatatgtacatatatatgtacatatatatacacacacacatacatagagtcatctgtgctgccagcattctttccaaactcaccatttgtctttttttttttttttttgagacagattctcactctgttgcccagactggagtgcagtggcacaatctcagctaactgcaacctcctcctcccgggttcaagcgattcttctgcctcagcctcgcaagtagctgggactgcaggcatgcaccaccacggctggctaatttttgtatttttagtagggacagggtttcacaatattggccaggctggtctggaactcctgacttcaggtgatccacccaccttggcctcccaaagtgctgggattacaggcatgagccaccacacccagtctaccatttgtcttcttatttcattcatgagtgttttttccatgtatattttaaaattttatggacccaaatatgcctaccttttctttgttaacatctgggtttcttgtcttggttcagaaggttttttccaccctttggttatacatattgtttatcttgcaaatttttaatccttttaacacaagtctgtaatccacctaaatttttttggatgatataaaatagtgattcaattttatttccttccaaaaggagaaccagttgttccagcaccatgtgttcaagtatccattttcccaaccaaatttagccaccatttttattacatgaaaatccttgttaagcaggaccaatttctgcacgctctattctattccactgatctgtttagtccgataccagtgccagattggttgggttactctgactttttccaaaattccagtgtcaagtaagatgagtcattcattcttcatttatacctttgatacatcaaggacatggcctactttcaggcccacacatgtttgatgtgtgtggggacaattatgaggcatttatttttccatatagatttatatattaatttattcaataactcacttcagaaaaatattgcatttgaaattccaatcaaaattttatttcatttacatatttattttgaggtgaactgacatttttataagacatattattttacaactcactatgtcctttcctttgatcagctctatattagttctatatccttccttgagatcttctaatattctccatataggtcctgtcttttaaaattatattcatttataaatactttagagtgtttatcactactgcaaataaaatatttctcctccttttcatttctagatgcttatttactggaagagagaaaggctattgatttttgtgttttatcttataaccattccaccttactaaattctttttgccattccctttattttaagcacttattactgtcttaagcatagttttttcaaacacagcatatggttacatttcatcttttaacccaatatgaaagtccctgtctttaggtgggaaaaatccagccattcaacatacagagtaactgctggtagaccttgttctattttttacaatttgttttatgtttagtatttggttctccttttttgacttttattgtcttagtttaggtcaaatgaccaagatgttcgtattcattttatttcttcccattgtgaatttggagctcttctgtccactcccattccattagcattgacttttcctttgctggctctcttctttgactctacattttgctacaaatatctggaagtaagatgttaactattctctctctctctaaagatatatatttactatatctatagatagatagatagatagatagatagatagatagatagatagataccttcttttaaatttttttttaagagatcaggtcttactctgtcacccaggctagaatgcagttgcacaatcatagctcactgcagctttgaattcctgggctctgtcaggcctctgagcccaagcctgcacgtatacatccagatggcctgaagcaagtgaagaatcacaaaagaagtgaaaatggccggttcctgccttaactgatgactttccaccattgtgatttattcctgccccaccttaactgagcgattaaccttgtgaaattccttctcctggctcagaagctccccgactgagcaccttgtgacccctgcccctgcccgtaagagaaaaaccccctttgactgtaaattttccactacctacccaaatcctataaaacggccccacccctatctcccttggctgactctctttctggactcagcccgcctgcacccaggtgaaataaacagacttgttgctcacacaaagcatgtttggtggtctcttcacatgtacgcgtgtgataggctcaagtaatcctccgtcctcaaccaccatgcccagctattttctctcttcatctctctgtctctgtctgtctgtctgtctgtctgtctgtctgtctgtctgtctctctctctctctctctcgtaaagacaaggtctcacgatgttgcccaagctggtcttaaactcccagcctcaagcaatcctcctgcctcagcctccagaatagctgggattataggggtaagccaccaagccctgcagatgtgaactattctctttcccaccaaagatgcctttgctcccaccaagattctcagcattgcttttactctctcttggcccagagagatgggtcctggagatattttcactttcctccttcagcttggtcctccttttcgcccaccaccccctccctctggcccctgcaatgagactttgaagttgatgtcaatttgcccccttaccgcaccactccgaactcctaggttttgctgtgatggtttcatagttttgaactctgtgtgatagtctcttccttctgtttgaggagaatttaacaagcatattatgctactcccagacagcttcatcatgttcatctgcgtctaattatgcacacacatatatacaatattatgtttaactacatatcgctgaatgccatgtaccctgcccttcatctccccatctttagtctatctttgggttcatttatcatttaatgaacattattatcaagtcccttttcagatggatcatgtgagtgtattcttctagtgaaggatggccttgactgagtatggatttggtttctccatccttttcactcagctgtctgtagatgcaattccaccatcttcaatcttctagttaatgcagagaagtctgatgtgagtctaattatttatccttttaggtaatttatttctgccaggaagctcataaaaccttctatttatgcttagaattcagggatttactaggatatgcctacatctatgccttttcttattaatccaggcctagaacttagtacaacttttccatccacagactctgtttttttctttgtctcaagaaagtggtcttctgttatgtcttctgttctttaattgtcctttctctatgtatccctttctcattttctgaaattcctgtagttcgtgtattaagtttccctcctctctcctcctagtctcttatcttgtctctcctgatttcaaagtcatgttgttctgagatttcagatagttcatgcacttggccctctgagccactgacttaggcctcaactatgactgacacctcctattcctttgtttagctcagagactagtcccagggagtctttttcttactatcacctgaacatctttatattactcttatgttttaaaattcaagtcatctgcttcccccaggccctctgtttcactgagtacctgttctgtctatcttggcttccctctctctctctacctttggaccctctagataggttatgggtttttgttttttttcacctctttagggtgctggtttagtttgattattaacatgtcctcagcagaagtttatgcaggtaaaaaggtagagctggtgtagaccagggcttagcccctggccccactgctgaggctcctggctagcagagcctctctgctctcaaggcttgctgtgctgacccagcatcaaaggaaggcagaacttaacccactatttcattgtattcttcagcagttgatgtccaagggaccaggcccatcctgtgggtaagtggtggcctttcctccactccctctgaagtcctcaggtctctgaggctcaagtgcttctcactgggtatcttaaaatgcctagtgtttaccctggaactccaggaaggtgatgtctgggcccttgctcaaccccacaggggataatgattcatacctgtaattaccacaaagccaggaccaccaccaccccccaaccacgctctggagattagctccctctgggatccgtagacaaggcaaacagaatggagaagggagacaagggctcagccagttagcagacttccagattccccctcattaacatcattagcattaaacgttagaaggagggaggatgacacaggaaaaaaaaatgggacaaaaaagagcggagtatttcacaaatcaagatgcttaggaatttgagactaatatttattaagcatctactatgtgccagatagacattgatacttttgtacattatcacatctcattctcttatcaatcctaaagttagatatgttgatcctcaattatagatgagaaaacagctacagatgagagactcaggaagattagtcgaaaagttcaaagtctaatgggtagaagaagtggcagagataaaattgaaattggaataaggtcttccctattccaagatcatgaccttttactgcaccgtactgagcacaggtactttcaaatgtatatatatatatatatatattttttttttgagacggagtcttactctgttgcccaggctggagtgcagtggcatgatctctgctcactgccacctccgcctcccgggttcatgccattcttctgcctcggcctcctgagtagctgggactacagccacccaccaccacgcccggctaattttttgtatttttagtagagatggggtttcaccatgttagccaggacggtcttgatctcctgacctcatgatctgcccaccttggcctcccaaagtgctgggactacaggtgtgagccactgcgcccggccctcaaatatttttcttaaaaaacaaacaaaccactctgcctagtagtgtctggttattttacaaggccttgtaacagtcacatctcccagtggtgacactacttggaatgaacatgctgtttctgagcaggggaagaattcattttcctcctgtaagaatctgccagaactaagaataggccagggacaacctgtgtatttaataaagccctgcatcaggagtgccagcctggtgaagcatccccttggctaatgaaggaaggcagagagatggctgtggcagggctgggatcaccagaacttgcctctcagatgtgctagacacacatgcaccctcacatgcacacataggctgctatggtttgaatgtgtcaccagattttatgtgttggaaacttagtacccaaattcatatattgatggcattaggtggtagggcctttgggagataaataggattagataaggtcatcagggcggggcccccacggggggactggcggctttataagaaggggaagagagaactaaattagtacactccttctgtcttgtcatgtgatgcttcccgccatgtcatgaggtagcaggaaggccctcagcagatgctgatgttatgcttttggatttcccagcctccagaactataggataaataaaccactattctttataaattacccaatctgtggtattcagtaatagcaacggaaaatggactaagacacatgcatatacacacatgacatgtacacatcatgtacacacacacaccagaaacatacacacatgcacatccacaccagacatgccacacatacaccacatacatacatacacatgcacacataaccatgatacacatacacacaaataacacacacacatacaacacacacatgcacacaccccacacacaaactcactgtgcataaacatacatatgcatgcatgcacacacaccacagatgcacacacatacacacatacatatgccacacatacacacaaacagcacacacttattcataccacacatgtgcacacatcacatgtaggcacacacatgcacacacatccccacatacatacatgcaccaaacacatagacatacacatggatacatgcacacacaccacacatgcacacgcataccacacatatacatatacatgcacacagacacacaaacaatgtacaatttaatactatcttcaacttgaatgtttgctggactcaagtcaaacagctttagcatacgagcaaagaataagaacttcccagttaatgactttgtattttttaaaaactgtttttaactcttggctcttgtatgttgcacaagtagctttatgctagcaatcaagcaaatgagaaagatgggaaacattcacccagaatccctctagtccagtccaacactttgttttaatttttccacatctctcctcatccctttgtcagatgaaggcatattttacaaagctccaatgtttttccacttgtcttttcctgtgttacaacattaccttcagaactattgttatcagccaaaatttgttccatcaagtggagatgtcttagtttactttgttgggtaaatatctccactgctgtatgtcaggactctgagcccaagctaagccatcatatcccccgtgacctgcacatacgcatccagatggctggtttctgccttaactgatgacattccaccacaaaagaagtgaaaatggcctgttcctgccttaactgatgacattatcttgtgaaattccttctcctggctcatactggctcaaaagctcccctactgagcaccttgtgacccccaactcctgcccgccagagaacaactccccttttcctttacctacccaaatcctataaaatggcaccacccctatctccccttgctgactctcttttcggactcagcccacgtgcacccaggtgattaaaaggtttattgctcacacaaagcctgtttggtggtctcttcacatggacgcacatgaaatttggtgccgtgactaggatcgggggacctcccttgggagatcaatcccctgtcctcctgttctttgctccgtgagaaagatccacctacaacctcaggtcctcagaccaaccagcccaagaaacatctcaccaatttcaaatctggtaagcggcctcattttactctcttctccaacctccctcactatccctcaaccactttctcctttcaatcttggcaccacacttcaatctctcccttctcttaatttcaattcctttcattctctggcagagacaaaagagacacgttttatccatggacccaaaactccggcgccggtcaccggcaagaaccccatcccttctctccgtgtctctaccccttctctgcttttctgggggaggggcatgaacccctcaaccccttctccttcacccttagtggcaagtcccacttttctgggggagaggcaagaacccctcaagcccttctcctgcacccttagcggcaagtcccgcttttctgggggaggggcaagaacccctcaactcctcctccttcaaccttagcggcaaatccttcttctctgggggaggggcaggaaccctgacatcttatctctgtgccccaatctcttatttctgcaccccgacctcttatctctgtgccccaaccccttatttctgcgccccacccccttctctgcttttctggagggcaagaacccctcaccccttctctatgtcttgactctcttttctctgggcttgcctcctccactatgggaaagcttccgccttccattcctccttttctcccttagcctgtgttcttaagaacttaaaacctcttcaactctcacctgacctaaaatctaagcatcttattttcttctgcaatgccacttgaccccaatacaaactcaacagtagttccaaatacccggaaaatggccctttcaatttttccatcctacaagatctaaataatttttgtcataaaataggcaaacgatctgaggtgcctgacattcaggcattcttttacacattggtccctccctagtctctgttcccaatgcaactcatcccaaatcttccttctttccctcccacctgtcccctcagtcccaaccccaagcatcactgagtctttctgatcttccttttctacagacctctcccctcctcgccaggccaagctaggtcccaattcttcctcagcctccgctcctccaccctataatccttttatcacctcccctcctcacacctggtccggcttacagtttcgttccatgactagccctcccccacctgcccagcaatttactcttaaaaaggtggctggagctaaaggcatagtcaaggttaatgctcctttttctttatcccaaattagatagcgtttaggctctttttcatcaaatataaaaatccagcccagttcatggctcgtttggcagcaaccctgagatgctttacagccctagaccctaaaaggtcaaaaggccgtcttattctcaacatacattttattacccaatctgctcccaacattaaataaaactccaaaaattaaattccggccctcaaaccccacaacaggacttaattaacctcaccttcaaggtgtacaataatagagtcgaggcagccaagtatcaacatatttctgagttgcaattccttgcctccactgtgagacaaaccccagccacatctccagcacacaagaacttccaaacgcctaaaccgcagtggccaggtgttcctccagaaccgcctcccccaggagcttgctacaagtgtcagaaatctggccaccaggccaaggaatgcccacagcccgggattcctcctaagctgtgtcccatctgtgtgggaccccactggaaattggactgttcaactcacctggcagccactcccagagcccctggaactctggcccaaggctctctgactgactccttcccagatcttctcggcttagcagctgaagactgacactgcctgatcacctcagaagccctgtagaccatcatggatgccgagcttcaagtaactctcacagtggagggtaagtccctccccttcttaatcaatacggaggctaccgactccacattaccttcttttcaagggcctgtttcccttgcctctgtaactgttgtgggtgttgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcccaatccaaagcctcctttgcatcctcctcttgtatcccctcaccttaacccacaagtataagatacctctgctccctccttggtgaccgatcatgcaccccttaccatctcattaaaacctaatcacccttaccccattcaatgccaatatcccatcccacagcatgctttaaaaggattaaagcctgttatcacttgcctgctatggcatggccttttaaagcctataaactctccttacaattcccccattttacctgtcctaaaaccagacaagcctcacgaattagttcaggatctatgccttatcaaccaaattgttttggctatccaccccatggtgccaaacccatatactctcctatcctcaacacctccctccacaatccattattctgttctggatctcaaacatgctttccttactatttctttgtaccctgcatcccagcctgtctttgctttcacctggactgaccctgacacccatcaagctcagccaattacctaggctgtactgctgcaaagcttcacagacagcccccattacttcagtcaagcccaaatttcttcctcatctgttacctatttcggcataattctcataaaaacacatgtgctctccctgctgatcgtgtcagctaatcttccaaaccccaatcccttctacaaaacaaaaactcctttccttcctaggcatggttggatactttcacctttggatacctggttttgctatcctaatgaaaccattatataaactgacaaaaggaaacctagctgaccccatagatcctaaatcctttccccactcctctttccattcctttaagacagctttagagactgcccccaccctacctctctctgactcatcccaacccttttcattacgcacagccgaagtgcagggctgtgcagttggaattcttacacaaggactgggaacgcgccctgtaacctttttgtccaaacaacttgaccttactgttttaggctggccatcatgtctccatgcagctgcagctgccactctaatacttttagaggcccttaaaatcacaaactatgctcaactcactctctacagctctcataatttccaaaatctattttcttcctcacacctgatgcatatactttatgctccccggctccttcagctgtactcactctttgttgagtctaccacaattaccattgttcctggcccagatttcaatccggcctcccacattattcctgataccacacctgaccctcataactgcatctctctgatccacctgacgttcaccccatttccccacatttccttctttcctgtttctcaccctgctcacacttggtttattgatggcagttccaccaggcctaatcaccacacaccagcaaaggcaggctatgctatagtacaagccaccagcccgcctcttagaacctctcatttcctttccattatggaaatctatcctcaaggaaataacttctcagtgttccatctgctattctactactcctcagggattattcaggctccctcccttccctacacatcaagctcagggatttgcccccacccaggactggcaaattagctttactcaacatgccctgagtcaggaaactaaaatacctcttggtctaggtagacactttcactggataggtagaggcctttcccacaggttctaagaaggccaccatggtcatttcttcccttctgtcagacataattccttggtttggccttcccacctctatacagtccgataacagaccagcctttattagtcaaatcacccaagcattttttcaggctcttagtattcggtgaaaactttatatcgcttacagtcctcagtgttcaggaaaggtagaacagactaatggtcttttaaaaacacacctcatcaagctcagccaacaactgaaaaaggactaggcaatacgtttacctctttcccttctcagaattcaggcctgtccttggagtgctacaaggtacagcccatatgagctcctgtatagatgctcctttttattaggccccagtctcattccagacaccagaccaacttggactgtgccccaaaaaacttgtcaaccctactatcttctgtctagtcatactcctattcaccattctcaactactcatacatgccctgctcttgtttacgctgccagtttacactgtttctccaagacatcacagctgatatctcctggtgctatccccaaaccgccactcttaactcttaaagtaaataaataatctttgctggcaaggctatgcgaacctccttaggcactctctaattagatgtcctaggtcctcccaattcttagtccttaaatacctgtttttctccttctcttattccgtttagttttttaatgcatacaaaactgtatccaggccatcaccaataattctaaatgacaaatgtttcttctaacaacctcacaatatcaccccttaccacaaaatctttcttcagcttaatctctcccactctaggttcccacgccgcccctaatcccgctcgaagcagccctgagaaacattgtctattatctcttcataccaccccccaaaaattttcaccgtcccaacactttaccactatttcattttctttctcttattaatataagaagacaggaatatcagacctctgagcccaagctaagccatcatatcccctgtgacctgcacgtacacatccagatggccggttcctgccttaactgatgacattccaccacaaaagaagtgaaaatggcctgttcctgccttaactgatgacattatcttgtgaaattccttttcctggctcatcctggctcaaaagctcccctactgagcaccttgtgacccctactcctgcccgccagagaacaactcctcttttcctttacctacccaaatcctataaaacggccccacccctatctccctttgctgactctcttttcggactcagcccacctgcacccaggtgattaaaaggtttattgctcacacaaagcctgtttggtggtctcttcacacggacgcgcatgaaactgtatctttttaattgtttgcaaagatttgccaccatacataacagcacagggaacattttcgtggagaggggttctactgttttggaggctggattggtgggtggatggatgggagaggttgaactgaaatttcatctttgtgggactcttgaagaaacccagagatggcgcgaggtactcacagagtgagaggctgagctaggagggtcagccacccagctcccctccagccagagctttgcttttgtctcttagatgttagaccttggcagacagtgttgtttcaccaaaaagtggcactgctgaacatatatttgaaactcagaggtcagaattagacctaagcagattcctatccagctcccttttgttcattaaggcatattatcattcatgaatgggcattgcatttaattaatcattcattcagcactttttgaagatccattctgtgccaggctaaattccaaaggtaaacatacagacagggagtccctgcttaactggccccagtttaggtcaagtgagagagacaccgtaatgatgatcatgataaaagttcacatttattggctttttactagtcaccagtatatgcccttgtttaattctcataagagccttttaaggttttacctgtgatatgcccattttacagataaggagattgaggcttagttataagccaaaggtccaggggtaataagtgtcgtgctgagctctctactgccatgcaaccctgcatctcttgaagaggtgacttgtcaaaccatatgacaatggcagcattgtgcagtataaaccatacagtgctttacagtgctatgccatataaaccctggaacatgacgtgctttccagggcaaaaacggcagaagtgacaaggaggagaaatttccctgacaaagaacaatggaatgcggggctttaagcataacaaatccttttgggctctttgaaaaactgggtcagctcccagtgctgaacaccctctttgcctggggttttctacctggaactgtgtgcagacgtcattactgccccccagaggactgaatggtctgacaatgctccccaaagttaatgacgaaaaattatgcaaaatctcaaggaaatgagaatcagggaaaatgtctgtcactccatgccaccatccttccctttggggctaaagttttgagacatgaaaaccaatccattttaacacaaaccccacggatgcttctgggaatgaagaaaaggctgcatttgcaaggagataaaagaaggtaaggtgggtcctctttggctctgttctctccccgttacagatttctgaaaaggcatcatttgggggacaggaaacagcttgggatctagctaccaactcagagtgtaaccttgggtgtctcacttcctctggatggctcttagcctctcctcttgggtcccatgaaggcattagaccaggtgttacagtccgggctgtccagagaaactgagccaataagagctatcttacctttagacacacattctttatgcatatctttatatacttatatatccatatctatgtagatatataggtatctatatatgcataaattatatattttatgtatgtattgtgaaaggaaaatcttggggcccccaaattactaagccacaaggaaaagtcaagctgggaactgctcagggcaaacttacctcccgttctattcaaagtcatccttctgctcgctgagacagatgcatacctgattgcctcctttgggaaggctaatcagaaactcaaaagaatgcaaccatttgtctctcaactacctgtaacctggaaactccctccctgcttcgagaaccaacgtatttcttacatatattgattgatgtctcatgtctccctaaaatgtataaaatccagctgtgccccgaccaccttggatgcatgtcatcaggacttcctgaggctgtgtcacgcgtgtgcatcctcaaccttggcaaaataaactttctaagttaactgagactgtcccagatattcagggttcacagtatgtacaatacaaattttatttatatatacacatgtgtatacatacctccatatatattttatacattatacattcctatattttcatatatttataatttatatgtacacatatagagagagatttatgtgaaggaatgggtgggagctgttatgggggctggcaggtctggtatctgtagggcaagccagtggactgaacacacaggctcaggtcgaagctgtagtcttcaggtagaatttcttctccagagaacttcagtttttactctccagacctttgactgattaaatgaggccaatctatattatgaaggataatcttttttagttaaagtcaactgattatgactgtcaaccttatctacagaatatcttcacaggagccaacacctggattgtagttgattaaataactgagtactagagcccagtcaagctgactcacgaggctaacatcgaaccaggtggtctccaaagtcccttccagctgagaaggagcagagactcactgatcctctgggccccagcgatactagaagaagcaggggatgcccctggaatgggtctgttgaagcctccatcgtttctcacacttcccaatccactaagcccagtgcaggctccggagaagggagcctggtccccaccccagctctgccacacagcacctaggagctcttaggactaaaacctggtcttctcacctgtcaaaagggggataaatggggccaggtgtggtggctcatgcctgtaatcccagcactttgggaggctgaggccggtggatcacctgaggtcaggagttcgagaccagcctggtcaacatggtgaaactcctactgaaaatacaaattagccagacatggtgatgggcgcctgtaatcccagctacttgggaggctgaggcagaagaatcgcttgaaccccagaggtggaggttgcagtgagccaagatcgcaccgttgcactccagcctgggtgatagatagaaagagtctcaaaggtggggcgaggggggataaatggtccccacctcaaagaccatgaagggttaaaggaaatggtatttgtgagctccttagcagagtaacaggcacatcaaaagtgctcagaaaatctgtactcaaaaccccaatacccacagcctgaggagccaattactctcctcttgttctctctaaaacccccttcaatcaggctgacacctctgcccctcccccaaagttgctgtggtcaaggtcagctgagccatcagcagcagtgctgccctggcggttccctcactcctggaaacactcccttgctttgatgtcccgagtccaatacatgaccccatcattcctcctgcttccctggctgctcccctcccctccccttggttggtccctcctcatcacccgcaccctgcacctctatacctcttccctgcttagttttattcaattgctacgtgcaacttgtttattttccctggctcctcccaccgtgaatccgtgaaggcaggtgctttgactgttttgttaattactttaccccagcgtctagaagagtgccttgtgcatggatgtttgtcagtggacgaatcaatacatgtgattgatgatgacaatggtggcaatggcagtgacgacatgacgaagtgtgcacataccctagatgctgttcaaacaacacccagtttggacggaacaaaggtgtgcagtgaaaagtatataaagaggatgtgatcaaatctgacttctcatcccagtaccctctgttcattacaagtagcttaactcacctgagctggattcatcccagagatttagacaatatccagcccaagaaccaagggatagtcagattctacttctaactgaagaaggtaagtgcacccacccatacttggagaactctcttccctgagataagctggcttgaccggctggagccgaaatggctgccctgttcccacactcgcctgctgatggcttgtgtctgggcttacgtctcttttccccggaccctgcccctagctccttctccttcttcggctttccccagcctctcagcttccaaagatactgcctagagccctttatagctgctttctttcccttctcatttctattcctgccttatttcaccggcatgtacactttacttattttacagcgagcctacaattttgaatccagcttttagtcttaacatcatggcctccacattgtatgcagttgcagaatgttctcatttttatgccccagtaagtgtgctgattggattatccatcacccactcagtgttggagctgggctctgtgctaggtccgtctcggtttccaaggagcttgcagcctggcttcaagatttcatgcccacgctagcttaaatagtccttattattggatgtttggggtttgttcagatatcccctttggtaaatgattctgggattaatatcgttgggcataagggttttcccagtttgggggtcgttcatttctttgaccttttatggagcacctctatactgtcagccggtctgcattcaactcgacaacatccctgcattcccatccccttctttgctgcatcacaaccaaatttcccagaggcatctttaaatgaggtttctgcttcatttctacaaatgagaagcccttgcttgacacatggcaggaaaaagagaagaagctgttcctattcaaaggaatctgaggataggcagctgggatcgtcagtaccaaatgccctttgcttcttggtgtccactgcagtcttcctgctccagggatgtgggcagctgggatcaccgacggtgcctttgctgtaaaacccaagcctttatactacctcggatggatgatgtggtgttcctctcatatcctctcttcagggggctgatgggtcacagttgtatccctcactggacattgccctccccgtggggtttggccttgcccaagcttacatcctttccaaaagaacggccagtagccagtggctggccagtgcctagatacaaaggcccagctctctttttctggtttgagacaacactgaagaccatcccagctccagagctccccgtaagactggctgaggctttgcagcaaccacactgcgagtcagcatctccttccacccagtcctccttcctcctttccttacagctgcatccccaagacacttttcagtaaaccttctatatacaactgtccttctcagagctgtttccagggaacccctagacactgatctttgctgcccaagctcttacaatgatcacataagccatacaatttcagagtatgtatttgctatggcaactgcactgattatcttgatgaaaacagaaattgaggctggaagtaaagctctgttatggcaacaaacctaaaatacgtgatacttgcttcattgtggggtgacaggcattgaggaaaattataacttaggaagcaaatatgtcaattcatgttgtcctaaaacactaccatgtgtggtgaaacctgcctatggttatttcggaagcagaccatgtgcttactaaattgacaactctagggttggacttggaaaacatgtcttcagtgctatgtgttggttgctattggctgcattcataaggtattataagaagagatgagcttacagtgaaaaaaaagttgggaggaggggagcagagagggaggaatagagagaatccagaaatgtgaagattagaccatgaaaagccaagtgcttctggatcccaaacaggaagacatggagcaaaaaagtctttaaggtataaaagctcaaccaaatttccctgtaaagatcaattcatggcaaagatcagagtaagggcaggattttcctacctactactccagatgacttcagtggcgcgtccattgagttgggtggggcacagggcaagggagtgaagaaataatgcagattgagaaccagttttaaaatagttttttgggtgcagttactgatgcatggatttggctgggagcaaataaatcacgagtgtatagcatacctcaaagatactgtgggtttgatttcagaccaccgcgataaagtgaaaaccaaaatcaagtgagatacatgaatattttggtttcccagtgcatataaagttatgtttacacatgctgtaagctattaggtgtgcaatagcattatgtctaaaaatgtacataccataattttaaaatactttattgctgaaaactgctaacaaatcatctaagccttcaatgaattgtaatcttttcattggtgtagggtcttgccttgatgctgaaagctgctgactgatcagggtgacggttgctgatggttggtgtggctgtgacaatttattaaaatagacaaacatgaagtttcccatatcgattaactcttttcttcacaaaatattctctgtagtattgtatgctcttagatagcattttacccacagtagaacttctttcaaaattgaagtcagtcctctcaaaccctatcactgctttatcaactcattgtatgtaatattctaaatcctttgctgtcatttcaataatattcaaagcatcttcactgggagttgacttcatctcaagagattttagcaattcactgatatcttcaagtttcccttctaattctagttctcttgctgtttccactacatcagtagttacttcctctgcaaagtcttgaacccctggaagtcattcatgagggttgaaatcaatgtctttcaaattcctgttcatattgatattttgacttcctcctatggataaggaatgttcttaatgacatttagaatggtgagtgttttccagaaagtattcaatttactttgtccagatccatcagaggattcactatctatggcagctatagccttataaaatgtatttcttaaataataagacttgaaagtcaaaattacctcttgatccttgggctgcagaatggatgttgtgctagcaagcatcgaaacaatattcgtctccttgtacagctccatcagagctcttgggtgactaggctcgttgtcaatgagcagtaatattttgaaaggaatcttttcttatgagcagtaagtctcaacaggggacttaagatactcagtaatttattcagtaatcaatttcattaatttctcctcttcagctatggaagtcctagatggccttttcttctagtagaaggctgtttcatctacactgaagccaccttcatcagtggtcttctggataacttgctgcaacttctacatcagcacttgctgctttcccttgctcttacatgttatggagacagcttctttccttaaacctcatgaaccaacctttgctagcttccagcttttcttctgcagcttcttcacttctctcaaccttcacagaactgaagagagttggggccttgttctgggttaggctttggcttaagaaaatgtggctgacttgatcttctattcttatcactaaaactttctccatatcagcaataaggctgcttagccttcttatcttttgtgtgtttactggagcagcacttttaatttccttcaagaatttttcctttacattcacaacttggctaactggcccaagaggcctagcttttggtctgtctcactttttttgacatgccttcctcactaagcttaatcatttctagcttttaatttaaagtgacagacgtgtgacttttcttttcacctgaatgcttcaaggcccattgtagggttattaactggcctaatggcaatattgttatgtctcaggaaatagggaggcttgaggagagggggagagatgatagatcagctaatcaatgaagcagtcagaacacatgcatttatcaactaagttcactgtttatggcaccccaagacaattgcagtagtgacatcagagatcattgatcacagatcaccataacagatataataatgaaaaagtctgaagtattttgagattaccaaaatgtgaaacagagacacaaagtgagcacatgctgttagaaaaataagacttgctgaacacagagttgctataaccctttaatttgtaatagatggaatatctgtgaagtgcaaaaaagtgaagtgcaataaaatgaagtttatacttgtgctacatttttgagggtcatgttaccaaagaaccatacagacagactgaataagaccttcagtcttcaagccttaaggcttgtaccaaacttttagaacagcagtccataaggagggcttatttctcaatgcctgattcatgtgctaccaaggaagcttacaaaaaaagaaataacctcatgggtagaaccaggctcatggagaaaagtgaacaaagcagcatctctcagagagcaaaactagagcctaatcatggatgccgaggatatgggctttcatgacgtctgcccagtgggatttcagaattgctatggacagtgactctatgtacttcccatccttcccttttccaagtgggaggtgcctattgaggccatattatctcagtttcatcattatatattggaagcagggttggcaggtgactttttttttttttccagttttggtatccttggaccaaaaggagccacatgcgaacttgctgggaagaaggccagacatcacccagagatctgagtttgaactggatgtggtgactgggggagattttagaggaggggttgagtgagctctatgtgggggcagaaagaaatgagaagacagtgatgagaagggcacgctcagcagagatggcatacaccaagtattccatgtgcttctttgcacttctcagcctcccttgcagctggattgagactgtgaataattatggcctgtgaatgcaagtggcatgtgtctttctctcttgcagaggcagtatatatcaagtgacatactaaaaagtagaagagacccccctgagcacattgaactttacacaaggaaaaacataaacctttattccatgaagtcatagagattcctgggttagttagtttctgcagcagaccctagcctgtcctgaccaatattctgactatgtgctacttttcttcaagtcactgagtaggaacagatattgaataacaaaatagcatgtttaggtagttatgaagtttccaaattttaataaaattctgatgctcctggtccctggacttctagaacctcttctgaaccagtctacaagtttgattgcacttattttttctgcttttatttctgagcgtgagggaggagctggaagactcactgatagctctctctcctctttctcactctagcccttcagtaaactgtgtgggctaggtttggggggaacttacattattttatattctttaatttactgaaatactatgtatttatatataaataatatacaactgcatttataaatagtattatgctagaggacacactcactggactttcctctatactccccaatcctacattaagttatattcaggtttgaggtcccccatgggactaggttgtttcattccttcatgctttgtctgcactccttcttctgtctggaacatcctctctccccaccaccttctccataccccaaactcacccgttcattttctcaaattgggctctctctgtgctcctgggctgactagaccaccccctccttggtgaacctgtggtgcctccagtaccccaaactcatcacaggaaggccctgtagacatttcccttctgtgataattaattccatgtgtcaacttgactgagctaagagatgcccagatagctggtaaaacatgatttctgggtgcatctgtgagggtgtttccagaagagattagcatttgaatgaatggactgagtagagaatgtgggtgggtgacatccaatctgttgagggcccagatagaaaaaaatgacagaagaggggcaaattctctttcttcttcagctggaacttccatcttttcctgacctttgacattgactccttgttcttgggccctcagactccaggacttacaccagcagcccctctgttctcaggcctttggactcagattgaattacatcaccagctttcctcggtctccagcttgcagatggcaaatcatggaacttctcagactccaaaatcacataagccaattgccataataaatctccttttagatctctctcttgctctttctttctgtgtgtgtgtatatatatatatatatatatatatatatatatatatatatacacacacacacacacacacacctatatatcttattggttctgtttctctgaaaagtcttgactaatacaccctctgtcttcccttcccttctcaactgtggggtcctggagccaatatctgtgttctgtggtctctgtttcccctgcaccagcacatctcattttgagttatccactggtcttggcttgtgtgactttggctttgggaggaggagtccttgggaattgaaggctcctgctatgctgagaccatgggaggtggggagctctgactatgctggtcctcaaaacaggacaaccaaccaccccttcgctgcatctctctgctttcaggacttgagtgttgctcttgaaagtaaggaaacccagggagaacggtgaggaaataaatccaagaactaagaaaggagaaatccctagatgagctctctctttggaattcctcatggaataggacaggccccagaggacactaactccaccaagatcagacatctgaatgtgctgagccaactaaatttatgctccaattaccctctgttgttcctcctagatgttcagtgaactttttggaagttcttgtggcctcagcacaaggactccaaaaacaggggcttggtcttatgcaagctccattattcaagggtgacagtatcctcacgggaacctgaatagccagagacaggagaacagggacagagcaaaggatgccatgtggactgccaccaccccacacctgcaggtttaaacactgagtatgtttcaataagaaaactgttcccaaaaggctctttgcaagaccaatatgaaaacaaagcctggatatatgctgagcagtgacacctgaagtgaggaggctcccatatttctccctcatatcccacacaggcagggtagtcatcttcccagggatctcacctattatagctagtgttgctgaccacctgctatctgctcttccctgttagaagtcacccctgcaccattccaagtttcccaccgattcggccaacactgattcactgcctacatgtaccaggcactgtgctaaccactgatggtctgaaatgagtaaggtgtatgcagtaaacggcaacattttagagggccagccttctaaaatgtgcaccatccaaatggctaagactgatctcagcccaacatgagacaaaggcccagatggtcaatgtccccttcccatttcagttttacactttccctgttgagcaactttccctgagctgttctcaggcaccagtgtcctcaaggtaccctgcagaattctccaccatcctccagtaaggagctgcacaccctcatcaaagctggccaatccactgtctatttacccagaactcaactgaccacaaaacatttgttttcttctttgaagctctgtagacaactcattcacccaacaaacacttaagaagtcccttctaggtggtggtcaccctggagtagaccgtggggtacgatgaaaaatgagacagtgatactgccttcaaggagtgaaggctcaaaggggcaaggtggacacacagtgccccatagcatggcaggtaagatggcaggagtcaggacatgcaacaacataaaggaatgtagagtcaatgcattctgaggacaaatgattccagagaggctttggggaggagattaagcaaaaggcatgagcagttgttcttgggtttccaggagaaggggtcagctgggggtttgtgtagaaaacatctctcaggaccatggccattggcctcctaaaggttcactgaaaaatcactggaatgagactgatggattaactggggaaaaggcataaaattatatttaatttttattcagaatgaagatccaacttcccaacgagctacaggaacttatatatcattttgaaattacagaaaaaatgggggcttggattctggtaaaacaggttattggaagggggagatgaggaattctattgaagggcaataagtgagtgctatgaagagtgattggatggggaacagagcttaccttgtaaatagtaaatagttttctttggaatgcagatgatccttggacagtcactatgcttgtaaaagagtctgttcaggtgtagtcacatcttggtcttcttttctgcaatagataatgagataatagggagaggaagaaagaacagttgttctccttggtgggtctggattttaggtagataaagaaacttcagcttctttgggagaaatggtggaagaagggggaggtcagggagacctgagccttcttctgttcagcatgtcaaaatgccatattttggagtatcagtttctgagctccaatacaacattcagcagaaggaaatagcatgagcaaaatcacagtagtataaattatccatgggaattctccacattctagatggtaagggaaagtccagtcataattgttaaaataatgaaatgggaggtcactagtttgaggtggctctgacaccctgggttcctgtataagccaactgaaacctaactcaggaattaaaagaaaacaaaacttaagctcaactaatcataggcagccaactgggcattcgttatcttgtcttaaacttcctattaggatagttcaaatgaggctatgaccacccaatgagttcaccatgcccactgcccagatagagccaatttatcgaaacaggggaattgcaacagagaaagagtttaacacacatagagtcaactaaccaggacaacagagttttattattactcagattggcctcccctaaaatttggaaggtaggatttctcaaagattggggtgcagggggctagagaatggatgctgctgattggttgagtatgtaatcacaggggtgtggaaaatggtcctcattctctgagtctgctttgggttgggaccataggattggttgtgtggagagtcacgggtctgggtggggtcatctgctcatgagaaatgcaaaagtctgaaaagacatcttaaaaggccagtcttaattctacaatagtaatgtgatttacaggagtaattggggaagttgcaaattttatgacctctggaataatggctggtaatcatttaactataaattcagacctctctcatccttctaacttggtgacttttcattagttttacataggggctttagttttggggaagatctattatcatttaaactataaaatttctcccaaccttagcttggccaacacctagaagtgaccagggctctttggaggttaaaggcaaaatggagttggttaggttggatctctttcactgttgcaattttcccactgttataatttttgcaaaggctatttcaaggcaattgctcaaacgttaactaatcaaataatttttttgctctgcttccacatttgttctacaaaagcctttccttcaaacctctttggcaagccctgaaccatttgaattctggagctgcccagttcatggattgttgaatgctcaaataagctctaatattttaatgtgcctcagtttatcttttaacaaaatgtatggtgtgtgtgtgtgtgcacatttatgtgctgttggggaaagaagtacacaggacaggaaggagtaggcaggggccagattctgcagggcttgtgagacatgtgagagagaggctggacttttccctgtggacaggagtctcagacttcacagtgcatcagaatcacccaagggtctattacaggcagattgctgggctcccatcagcagctctggttcagtaaggcaggtagcaggcaaggagtctgtatgtgtgatagatggccaggtgaccccagtgccgtggtcctgggagccctgcatgttatgggagaggtagagcctgtggacatcaccttgacgcaaccccaccctagctgacaaaatcaaaagccaatcacctttggtagagttcacgctgttacaggaaaggagtccagatcctgaccccaagagagggttcttggatctcgcgcaagaaacaactaagggcgagcctgtagagtaaagtgaaagcaaccttattaagaaagtaaagaaataatagaatggcaactccatagacagagcagccccgagggcagctgtttgcccatttttatggttatttcttgatgacatgctaaacaaggggtggattattcaggccttccctttttagaccatataaggtaacttcctgacgttcccatggcatttgtaaactgtcatgttgctggtgaaagtgtagctgtgaggacgaccagaggtcactctcgttgccaccttggttttggtaggtttcgcttggcttctttactgcaacctgttttatcagcaacgtcttcatgacctgtatctggtgctgacctcgtatcccatcctgtgacttagaatgccttaactgtctgggaatgcagcccagtaggtctcagcctcattttacccaacccttactcaagatggagttgctctggttcaaacgcctctgacaaaaccatcatctcctaaaatcaggattcaggatttctgtgagaataagggctctgcccattctgtgctcccactcacagactcacagacgaggctctgagacaggaggagctcaacggcagctgcagcctgtatctgtcagtggcagagctgggattagaagcctcgccatcaccccgctccacagtgccacagccacagccatgactgtcgcagaaaagtcatccctggctctccaccagcctgtcagggcccaggatgggtcagctgctagagtccctgctgttctgcctgtagggcatgttaactgaatagagtgctctggggagccagtgggatgagtctgtagtgaagacaactcaggtgctgtgacaggagagagttactggcagatcaggtctttctcccaagcctctaatcagagcacaaaagagtcattcagtcatcactgagaaaattccaacaaagaatatcattaagtactttgcatttaataaagggcctttaagtgcaatagcatatataaagccaccctggagtggcattaatggtcagactttgggtctatggaaagctaattgaaatgtttttggagtccctgtctgagcccttccagcaacaggaaactcactagtcctgaagacagattgttctgtttggggatgcccctgagtgcagttcaaattcctttttgccaggctcttcagccacaggtctgtgtagtatccacagcggaaagaggtctctcccccgtgggtcccatcaggagctagggagagaggagctctgcaattgcagagttcattgtgttctgagaaggcaaatcatttattgtggggacaatttagccaattagcagaatttagctaaaagcatttcttatgcaccagagccccctgctggctaaatagaagtattgatagtcctgcagaaggaccctctaagttggagcactcccaatttaggatatccggactttctgctggtggaatcaaatcacacaccttcaaaatctgttgagaatcgtgtggcttatcccataatgagttccaggggtcaactatttaggaggtggagggagttaattagagtccattagagtcctatttcactcaggacactgagatgaattcccagatgaattaaagagttacatattaaaatatagaatactaaaagaaccaggagaaaataaatatggatccatattaatttgattcataatggaaaataccttataaatgtagaaccaaagtaagattttataaatgaaaatataaatagatttggcaagggaaaagacgtttatttcttcatagcagtcatcttagactgaaacagacctaggatggagacttgtgtgcaggaggtttattgggaaaggctattggaatggcacctgcaagagaatgagtaggacaggtggagggacacattgaacggcaatgcaatagcaacagggctgaggatggccccttcagctgtcctgaattaaagtcaagggctcagagctttgtgtgtcctaatggcccaatcattggatgtgagatccactagggaggcagcttccttaggcaaggacaattcctagggaaggactctgcttgagccatgagcaggcagcactcctggcagctggggaaataggtgcctctatccttcactgggaatctgggtggcacactacagcatccactacacccatgcttgactatgcccatgcgcattttatcctacccttggcaacacttacaattgatatgtttaaatacttgccagggtaaaaataaaataatatagtcttaatttgttgaagtacctttttgttaatatatttactgattttatcccatattttgtagcttgcctagtcaaattccttgtttccttttctactaattttagtttctctaagtgtattcttaagaactttaaaactttatactctaatttatgtttaccctccattccaaccagttagatttcattttcttccttttccttaaaagcctgaaggtagcatctttaatgaatgctagctgtcaactgctgaaatgacagtcaagttctttcaagaaaaatttatcttctagcaaaaaatcatttagctccacttgtagatgttctgaaatctagatatggttactgaatcttttgtatccccaaacgtgtacatgggcaagcctctaaaaaagccatatactcttttaaaattattctttatttaacttttattttaagttcagggctacacatgcaggtttgttacataggtaaacttttgccatggtttttttttttaacagattatttaatcacccagctattaagcctaatacccattagttatttctcctgatcctctctctcctcctacctccttcctccaatagtcccaagtgtgtgttgttcccctctatgcgttcatgtgttctcatcatttagctcccacttataagtgagaacatgcactgtttggttttctgttcctgtgttagtttgctgaagataatggcttccagctctatccatgcccctgtaaaggacatgatctaattcctttttatggctgcatagtattccgtggtgtatatgtagcacattttctttatctagtgtatcattgatgggcatttgagttgatttcatggtgctgcaatgagcatatgtgtgtatgtatctttataatagaatgatttatattcctttgggtatatacccagtaatgggattgctgagtcaaatggtatttctatttctaggtctttgaggaatagcctgtattacacaattgttgaactaacttacactcccaccaacagtgtataagtattcctttttctctgcaaactcaccagcatctgctattttttaattttttaatagtagccattctggctggtgtgagatggtatctcattgtggtgttgatttgcatttctctaatgaacagtaatattgatttttttccatatgactgttggccacatgtatgtcttcttttgaaaagggtctgttctgttcatgtccttggcccactttttaatggggttttttttttcttgtaaatttgtttaagttccttatagatgctagatattagacctttgtcagatgcatagtttgcaaaatttttctcccattctgtagactgtctttttactctgttgatagtttccttttctgtggagaagctcttcagtttaattacatcccatgtgtcaatttttgcttctgttgcaattgcttctgggtctttgtcatgaactctttgcctgctcctatgtccagaatggtattgcctaggttgtcttccagagtttttatggttttgggttttacatttaagtctttaatccatctcgagttgatttttgtatatggtgtaaggaaggtgtttagtttcaatcttctgcatatggctagccagttctcccagcaccatttattgaatagggaatcctttccccattgcttgtttttgtcaggtttgttgaagatcagatagttgtgagtgtgtggtcttatttctggatctctattctgttccactggtctatgcatctgtttttgtaccagtactatgctgttttaattactgtaaccctgtaatataatttgaagttgggtactatgatgcctccagctttgttctttctgcttaggattgccttgactttttgggctcctttttagttctatatgaattttaaaacagtttttttttctagttctgtgacgaatgtcaatggtagtttaataggaatagcattgaatctataaatttctctgggcggtatggccattttaacgatattgattctttctatccatgagcatggaatattttttccatttgttagtgtcatctctgatttctttgagcagtgttttataggtctccttgtagatatctttcaccactctggttagctgtattcctaggtattttatttttgtgtggcaattttgaatgagagttttttcctgatttggctctaagtttgactgttgttggtgtataggaatgctagtgattttagaacattgatttttacatcctgagaaaatgccatatatttttaaggatcaccttccaagaaaaatcattagttgtcaagataggagacttttcttcataatgaatataaatgtcacatgttggcatagtgaaagtgtttggagaaatgctgttgttaaaatagacttggtgaggctgagactttgaaatcacctccctttaagtaaaagaaaatagacaattcaaaatagaagcaataaagattctatctattgcatccatttaactcaatgtcccaggtaattgttgaatgtctgccctctggaaggcactgggctaagcttgagtgatttatgtgtagcttcttcagtagagcattcaaagtcctttgtgttcttgttcaacctaaggttcgatactttcctccagtcacatctacaatgatgcttaaagtgcagccacacaggaccctggggtggtcccagaatgtgttgtctgcctctcacatgccgccttgttgatgagagtccttctagcatcccccttctccacatcaggagctgctactgagatcccaacctgtagctcaaatcttctttccatgtcaactgtttgcttgcccctgtccctagcaaaagctaacccttccttctctaggctcctacagcactttgtccagtgccaaccatagtctttctgtagattttgacaattgctctctccaacgtcctatgtggccacaagagagtgaggtgagcccttcacattgtgcaatgtgcagccaataggcattgtaacaaaagtttgtgaataaacaaatgagtagatctggaaagcattttgtagtttacaaaatgttttcgcagacttgacgcaatttaatcctcacaccagccctgaaggcttgaaattgttatgagagagaaagagacagagagagagagaaaggagacagagagtaaaacaggtccctgccctcaaaaggtttacaagctgatgagggagacagagatattgtaagcactggacagtaatagaaacctagacaagatactgcagaatcagatttgggggtcaagaggtaaaaaaggtgaattccaacttaaggggaaaataaataatattcattttggtttttctatgagtgagagaaatcctagcaataacttgaacacaccacacaggggcagaagaagctcattatcattaggatttaatattcctccatgagtgcgtgcctgctcataattctacattgagtggagatgccaaaagaaatgaggatcctcacatttattgagtgcctactgtatgccagaaagtttacatggagagagttggttaatcctttagcacaagtaatcctgtaagggattcttatctgtcctccccatctcctttccaaattctctccacttcctttcctcccccaccgtgatgtgacttgtccattgtcacacatgtggcccaaagtggagctggcgttcaaattcatgtcagattccaaagtctaactgcatttctttcatttcttttactttttttactttttctttttcacacttttaaaatcacaccaataatacaaaaatacattctcatcattaataaagacattgcagataaacacatgtcaccctgaccctcacctaatcccaccacatgcccacatatacaaatgtttctctcagtttggtgtatctctttccagatgtttgtccatgcacttgcaaacatgtagatatttatttaaacaaaaatgagttcacatagaatcattatttcactgttgtgatatacttattgtcttaaaatatatcttataattacatactatgtttaaaatttcatgatgagcagaatttgtttttgcaaaataatccattagagtggatgaaactaatgaggtctttgattgattattgttgtagctgggtgatggggttcattatactgcaatctgccataatacagttttaaaaaatactcatagacttccattctccacttaggagataggcaaatggaaaaaaaaatcgcttccatctttacaacaacaaatatgctggacaacctgtaaatcttgcacctgttaaagaactgaggtcacagggcaaccaactaatgtgaaatctaaggaaatacaggatcccccaagaagaaaggggaggtgagcccttgcttacctgtggtaaatctcaccagacactggtaagaaaaatcagctaaaaatgctaacaaattgctaaaggacaaatacagacaggtgagaggatatagaactactgggaatcacaagcacaaggggaatatgtagctgctagctagctgttctccaagctagatgattacaagaaagatggggtcagagcatgagtgctgagaggcatcactgatggtgctgacccaggagaaaggcacagtagtcactgtgagaaaaacattaaaccctacctggatccttttttctatgtctcctacagaacaaatggcttatacccctggggaaagacaatacacactctgtcacacttagcacattgatggaaacccattctagctgggagaaggaacataaaaatacattctacctttgcagaaggtgcaagatcactgtcccctgaccagacccacagttggaagtgtgcgatactgctgagaaggccccatctccaagacccagggacacagttcttgcctctaaaactgaggcttagccagaacaggagaggatgccccagctctgcctctctttagaggcagaaatgacttcatggccaatgacttgtgtgatcacacagcccatgcttagaagggtcctgcatttggtttaatactctactattgccatcctgacagttttaatactttctgagcaaggagcccttcatttttatttttcacctgcaaactctgtagcacatcctgtcaacaggctacaacagcgtcaagtaacaaataacagcagtttccagctgggaaagagacaagagcatgaagagagactctttctctctttctctctctgtctctccaggcatggcacaaaggaaaacttaaagtcaagggtgaagcagatattgactaaaaaaaccactctttaagagcagcccatatgctagatatgacttcattggtgaattctaccaaacattcaaggaagaaatatgaattacacacaaactcttccagaatgtagaagaggaggaaagacttcccagctcattttctgaggccagcattacacaggtaccaaaaccatccaaagaaattcaacacacacacacacacacacacacacacacacacacacacacacacacctagagaagaatatcactcacggatacagatacaaaaaattcttcagcaaaaatattagcaaattgtgccatatatatgtacgtatatggtaatacattattactaagtgggatcttttgcaggaagttcaggccatttcaacatccaaaaatcaatcaatgtaattaatcacatcaacagactaaaaatgaaaaaccatgtaaccctctctatagatgcagaaaaaaataatttaatacaattcaacaagtcttaaaaaatattgaatagaaagaaactttcttaactcaagaaaggatacgtaccaaaaaaaaaaaaaagccacagttaatatcatacttaaaatagaaggctaaatattttccccaaagatcaacaacaaggctgggatgcccctcctcaccatgcttatttaacatcatactggagttcctagctagtttaataatgtaataaataaatgtctctacttgcagacaatgtgagtttctatgtagaaaatcccaaagaatctacccaaaaagctaccagaactactaattttcacaaggtcataggattaaaggtcaacatttaaaaatcaatcagggggtggggtcaagatggctgactagaagcagcaatggtcggaggctcccaccgagaagaaacaaaacagcatgcaaatcctacacctgcaaccaagatattcaggttctatcatcaggactaactaggtggttggcatgacccacggagagcaaagagaagcaggatggtgcatcagcctacctgagagccacacgggacaaggggagcacccccatgcccagccaaaggaggcggtgagtgagtgtgctacccagcctgagaaattgtgctttttccacagatctgtgcaacccacagatcagaagtttccactcatgagcctacgccaccagggccttgggtcccaaccacagagccacacagattctcaacagcctctcagctgaaatctgcttaagactacagagttcccagcaggaggggcagccatcatcactgtgcctgcctgttgtctaagtcatctgagctccctaggggaggggcagcaaccatcactgtggttaccagctgccagctgcctaagacaactgagattcctgagaaaggggcagccatcatcactgtggctgccagctggctaagaaagttgagctccccagggaagagacggcagacatcactccggctgctagctgcctaagacactgaactcctggggaggggggacggcagcagccatcactatagctccaggctgcatttctcccctgctagagccagggagactgcatggcttggtcccgagaggtattccccacagcatagcacaccagctatgacagactatggccagactgcctctttaggctggaccctgactcatcccacctcactgggtggggcctccctgtaggaactccagtaactccagccaggggcttaggggcaaaactctgatctccctggacctgagcccctatggggaggggtggccatggtctctgttgacccgcagacttagtctctctgcttgctagctctgaggaatctgggcagcccagattagtgggtttccccttagtgcagcacaccccctccaccaagagacagccaaagtgcttcattaaatgggtcctgattcccatgccccccagttgggtgagagctcccaacaggggtcgccagacaccctatacaggagcactcctactgccatcaggtcagtgccccttgaagtcagagatcccagtagaaggagcaggcacccatctttgctgttctccagcttcctccagtgacatctccaggtgggggaaggacccagatgaataaggcctcagcaaactgcagcagccctacagaagagggatctgactgttgaaataaaaacaagcaagcagaaaacaacaacaagagcttcaacaaaaaagtccccacagaaaactcgtccaaaggtcagcagcctcaaagattgaagctagacaatctcatgaagatgaggaagaatcaacaataaaatgctgaaaactcaaaaggccagggtgcctcttctccaaatgattgcaacagctctccagcaggggcacagaactggacggggaatgagatggacaaattgacagaagtagccttcagaaggtgggtagtaacaaaattcactgagataaaggagcatattctaacccaatgcaaagaagctaagacccatgacaagaggttacaggagctgttaactagaataaccagcttagagaggaacataaatgacctgatggagttgaaaaacacagcacaagaaatttatgatccaaatataagtatcagtagctgaatcaatcaagtcaaacaaagaatatcagagcttgaagactatgctgctgaattaagggaggcaggaaaaattagagaaaaaagaatgaaaagaaatgaacaaaacttcccaaaacaatgggactatgtaaaaagactaaacctacgactgattggagtacctgaaagagatggggataatgcaaccaagttggaaacacacttcaggatatcatccaggagaacttccccaacctagcaagacaggccaatattcaaattcaggaaatatagagaaccccagtaagatactccatgagaagattaactccaagacacaaaattatcagattctccaaggttgaaatgcaggaaaaaaatgttaagggcagccagagagaaaggctggatcacctacaaaaggaagcggtggacctctcagcagaaaccctacaaaccagaaaagagtggggtcaatattcaaaattcttaaagaaaataattttcaacccagaatttcatatccagccaaactaagcttcataagcaaaggagaaataaaatacttttcagacaagcaaatgctgagggaacttgtcaccataaggcctgtcttgcaagagctcctgaaggaagcaataaatatggaaaggaagaactggtaccagccactgcaaaaacacactgaaatactaagaccaatgacactatgaagaaactgcatccactagtgtgcaaaataaccagctagcatcatgatgacaggatcaaattcacacataacaatattaaccttaaatgtaaatgggctaaatgccccaactgaaagacacagattggcaaattggataaagagtcaagaccaattggtgtgctgtattcaagagacccatctcatgtgcaaagacactcataggctcaaaataaagggatggaggaaaatttaccaagtaaatggaaagcagaaaaaagcagaggttgcaatcctagtttctgacaaaacagactttaaacaaacaaggatcaaaaaagacaaaaagggcattacataatggaaaagagatcaattcaacatgaagaaccaactatcctaaatatatatgaacctaatacaggagtatccagattgataaaacaagttcttagagacctacaaagagacttaaactcccacacaataatagtgggagactttaacacctcactgtcgatatattagacagatcattgagagagaaaattaaggatattcatgacttgaactcagctttggataagtgaacctgatagatatctacagaactctccaccccaaaacaacagaatatacattcttctcactgctacatggcacttactgtaaaatcgatcacataattcaaagtaaaacactcctcagcaaatgcaaaagaacaaaaatcataataaacagtatcacagaacacagtgcaatcaaattagaactcaagattatgaaacccactcaaaaccacacaactacatggaaattgaacaacctgctcctgaatgactcctgggtaaataatgagattaaagcagacttcaagaagttctttgaaaccaatgagaacaaagagaaaatgtaccagagtatctgggaagcagctaaaccagtgttaagagggaaatttatagcactaaatgcccacatcagaaagctagaaagatctcagatcgacaccctaacatcacaactaaaacaactagagaagcaagagcaaacaaatcccaaagctagcaggagacaagaaataactaagatcagagcagaactgaaggagatagagacaggaaaaatcattcaaaaactcaatgaatccaggagcttgttttttgaaaaaaataataaaatagatggctagctagactaataaagaagaaaagagagaagaatcaaatagacacaataaaaaatgataaaggggatatcaccattgaccctgcagaaatacaaactaccatccaagaatactataaacacctctacccaaataaactagaaaatctagaagaaatggataaattcctggatgcatacaccttcccaagactaaatcagaaataagttgaatccttgaatagaccaataaccagtcctcaagttgaggcagtaataaatagcctaccaactaaaaaaagcccgggaccagatggattcacagctgaattctaccagaggtacaaagaagagctggtaccattccttttgaaactattctaagcaattgaaaaggagggacttctccctaattcattttataaggccagcgtcatcctgatccccaaacctggcagagacacagcaaaagaagaaaacttcaggtcaatatccctgataaacattgatgcaaaaatcctcaataaaacactggcaaactgagtccagcagcacatcaaaaagcttattcaccacaatcaagtcagcttcatccctgggatgcaagcctcattcaacatacacaaatcaataaatgtaattcatcgcataaacagaactaatgacaaaaatcacatgatcatctcaatagatgcagaaaagatcttcgatgaaattcaacatccctttatgttaaaaactctcaataaactaggcattgatggatcatatttcaaaataataagagccacttatgacaaaaccacaaccaatatcataccaaatgagcaaaagctggaagaatttcctctggaaatcggcagaagacaaggacgccccctctctcaacctattcaacctagtattggaagttctggccagggcaatcaggcaaaaggtagaaataaaaggtattcaaatcggaagagaggaagtcaaattgtctctgtttgcagatgacataatcctataactagaaaaccccattgtctcagcccaaaagctctttaagccaataagcaacttcagcaaagtctcaagatacaaaatcaatgtggaaaaattacaaacattcctatacaccaacaatagacaagtggagagacaaatcatgaatgaactctcattcacaattgctacaaagataataaaatatctaggaattcagctaaaaaggaatgtgaaggacctcttcaaggagaactacaaaccattgctcaaggaaataagagaggatacaaacaaatggaacaacattccattctcgtggataggaagaatcaatatcctgaatatggtcatactgcccaaagtaatttatagactcaatgctatttccatcaaactatcattgacattcttcacagaattagaaagaactattttaaaattcacatggaaccaaaaaaagagcccatatagccaagacaatcctaaacaaaaagaacaaagctggaggcatcatgctacctgatttcaaactacactacaggctacagtaaccaaaacattgtactggtaccaaaacagacacatagaccaatgcaacaaaatagagatctcagaaataagaccacacatctacaaccatctgatctttggtgaacctgacacaaacaactgagaaagaattttctatttaataaatattgcttggaaaactggctagccatatgcagaaaactgaagctggacccctttgttacaccttatacaaaaattaactcaagatggattaaagacttaaatgtaaaacccaaaactatagccagatgcagtggctcacgcctgtaatccctgcactttgggaggctgaggcaggtggatcacgaggtcaggagatcgagaccatcctggcaaacacggtgaaaccccatctctactgaaaatacaaaaaaattagcctgatgtggtggcgggcgcctgtagtcccagctactcgggaggctgaggcaggataatggcatgaacctgggaggtggagcttgcagtgagctgagatcgcaccactgcactccagcctgggagacagtgagactctgtctcaaaacaaacaaacaaacaaaacaaaaaaaaacaaaacccaataaaacccaaaactataaaaccctagaagaaaatctatgcaataccattcaggacataggcatggatgaaaattttatgatgaaatcgccaaaagcaattgcagcaaaagcaaaaattgacacatgggatctaattaaagtaaacagcttctgcccagcaaaagaaactatcatcagagcaaacaggcaacctacagaatgggaaaaacttttgcaatctacccatttgataaaggtctaatatccagaattgacaagaaacttaaacaaatttacaagaaaaaaatgaataaccccatcaaaaaataggcaaaggacatgaacagacacttctcaaatgaagacatacatttggccaacaaccatatgagaaaaaaagctcaacatcactgaccattaaagaaatgcaaatcaaaaccacaatgagataccatctcactccagtcagaatggtgattatcaaaaagtcaagaagcaacagatgctggcaaggctgtggagaaataggaatgatttacactattggtgggaatgtaaattagttcaaccattgtggaagacagtgtggcaattcctcaaggatctataatcagaaataccatttgagccaccaatttcattactgtgtatatacccacaggaatatatatcattctattataaagacacgtgcacatgtatgttcattgcagcagtattcacaatagtaaagacatggaaccaacccaaatgcccatcaatgatagactggacaaagaaaatgtgatacatatacaccatggaatattatgcagccataaaaaggaatgagatcatgtcctttgcagagacatggatggaggtggaaaccatcatcctcagtaaactgacacaggaacagaaaaccaaacactgcatgttctcactcataagtgggagctgaacaatgagaacatatggacacagggagggtaacaacacacactgggacctgttgttcccctccctgtgggacctgttgcggagggcaggggaagggagagcatcagggtaaatagctaatgcatgtgagcttaatacctagatgatgggttgatctgtgcggcaaaccaccaccgcacgtttaactacataacaaacctgcatgttctgctcatgtatcccaaaacttaaaataaaatcaaattaaaaaaaaaaaacagagaaagggattgccaaaattgtaaagaaaaaatcatatttctttatactaccaatgaaaaattagaacttgaaataaaaataacagtacattttaaatactaccaaaaatataaaatacttgggcataaatattataaaatatgtgcaatatctatactctgatagctgcaaaacactaatgaaagcaatgaaagaaggcctaaataaatgaagaggcatatattgttcatgaatggaagattcactattattaagatggcaattatcaccaaactgatatatagatttagtgcgattccaatcaaaatctcaggccaggagtggtggcacatgcctttaatcccagcactttgggaggctgaggcaggaggattgcttgagctcaggagtttgagaccagcctgggcaacacggtgaaaccccatgtctacaaaaaatacaaaaattagctgggtgtaattgtgttcacctgtagtaccagctactcaggaggctgaggtggaaggatcacctgagcctgggaagtcgaggctgcagtgagccatgatcataccactgctctccagcctgggtgagagaatgagatcctgtctcaaaaaataaaaataaaaataaatttaaaaatcctggcaggacttttttgtagaaattggcaaagtaattctaaaatttttatggaaattttaaaaaataactagaatggcaaaacaaattgtaagaaaagtagcaaaattggaagactcacactaccagattttcaggcttactataaagctggcagtcaagagaatctgctattagaaaaggattaacatctagattagtggaacagactagaatagaccaatacacatgtggtcatttggtttttgacaaagtcccaaaggcaacttaatggagaaatgatagtttttctcaacaaattgttcttggacaattgaatatccctaggcaaataaatggatatgcctcaaggcatgcattacccactatagaaatattaactcaaaatagatctcaggcctaaatgtaaagcctaaaaccacaatacttttgggaaaaaaaaataggagaaaatctttatagccttaattaggtaaagctttcttaaatacaacaccaaaaacatgacccataaaagaaaatatgataaatagggcctaatcaaaattaagaacttctgccctttgaaagacactttaaaaaatggaaagaccagccacagactgggaggaaatgtttgacattacatgtcaggtaaaagacttgtttctaatgtataaagaacttttaaaactcaataaacaaacaacttttaaaatagacaagatatttaaatgggaacttttatcaaagaagatatacagataacaaataagtatatgaaaagatgctcaatgtccttagtcatgaggaaaatagaattttggaccaaaatgagataaagctacataccaattaacataactttataaaaagcaaacctgatgacaggaagcttaggtaaggatgaggtgcaactggaactctcataccttgctgttgggaatgcaaatggtacagacacttatactttggcattttctcactgtatgaggccattcttgcattgctataaagaaatacctgagactgggtaatttataaagataagaggtttaattggttcacggttctgcaggctttacagaaagcatagtgctggcatctgctcagcttctagggaggcttccggaaacttacaatcatggcagaaggcaaagggtaatcaggcatgtcacatggtgaaagaaacagcaagaaagagagaatggagagggggaggtgccacacacttttaaacgaccagatctcatgtgaactcagagcaagagctcacttatcatcaaagggatggctgaagccattcatgaaggatctgcccccattatccaaatatttcccacaaggccccacctccaacattggggattacatttcaatatgagatttcagtgaggatggatactcaaactatcattctatccctggcccataaaatctcatgtccttctcacattgaacaacacaattataccttcccaataatcccccaaagtcctaactcattctggcgtaaactcaaaagtccaaagtctcatctgagacaaggcaagtcccttccacctatgagcctgtaaaatcaaaacaagttatttcctcccaagatataatgggggtataggcatttggtaaacattctcattccaaaagggagaaatcagccaaagaaaggggctacaggccccacgcaagttcaaaacccaacagggcagtcattaaatcttaaagctccagaataatctcctttgactccatatcctgcatccaggcacactggagcaaggagtgggctcttaggaagctctgtacctgctgcttttccatgctgagattgcaagttactggtggttctaccatttccacttctggagagctgcggcacccttcccacagctccactgggtggtaccccattggggactctgtgtggggactccaaccccacatttccccttggcaatgccctagcagaggtctctctgggggctccacccctgcagcagacttctgcctgggtatgcaggctttctcatacagcctctgaaatctaggcagaagctgccaagtattcttcactcttgcactctgcacacctgaaggctaaacacgacatagaggatgccaaggcagcaggctgagctgtatctgggtccctttgagccaaggctggagctggagcagtccagatgtggggaggagtgtcacaagactgcacagggcatagaggccctgggcctggcccttaaaaccatttagtccttctaggcctcaaggcctgtgatgggaggggctgcctcttagatctctaaaatgtctttgaggccttttcctcattgtcttggatattagcacttggctccctttcaattatgcaaatatctctaacacatgattgatccacagtctgtttgaattcctctactgaaaaagctttttctttctttgccacatggctaggctgaaaattttccaaacttttatcctctgcttcctgtttccaactgttccaaaattccaacttttaagtcatttctttctttgcacatctgaacataggctgttagaagcagccaggctatatcttgagcactgctgtttagaaatctcctccaccagctcctctaggttgtcactctttagttctaactttcaacagatccctaaggcatgaacaaaatgcagccaagctctttgcataacacacatgacctttgctccagttcccaataagttcctcatttccacctcagctgctggacttcactgtccatatcactgtcagcattttggtcacaatcactgaaccagcttctgagaaattccaaatgtttcctcatcttcctttcttttcctgagccctccaaacacttccaacctctgcctgttaaccagttccaaagctgcttccacattttcagatatttttatatcaatgccccactccttggcaccaatttcccgtgttaggccattcttgcattgctataaagaaatacctgagcctagataatttataaagaaaagagatttacttggctcatggttctacatattttacaagaagaatggtgctggcatctcctcagcttccagggaggcctcaggaagcttacaatcatgacagaaggcaaacgggaaggaggcatatcacacggtgaaaaccagagcaaaggagagagaaagagtgggcagcaggaggtgccacatactttaaaatgaccagatctcgtgtaaactcagagtgagagctcacttatcaccaagatgttggcccaagccattcatgagggacctgcccccatgattcaaacacctaccaccaggccccacctccaacattaaagatcacaattcagcatgagatttgagctgggacaaatatgcaaactatatcactcacaaagttaaatacatacttaacatatggcataacaatcccactccaaggtattaatccaagtgaaattaaaactatattcacataaaagctgtgtatgaatgataccaccacaaggaatggtgcagtaaggactttatgtgataaatttccaccccatttttaataacaaagcaaatagacaaaagacaaagaaatacaagacttgaacaatactgtaaagcagctatgtctgtcactgaggaagacaagcatctatagaacattccactcagcactaaaaaaatgaagtcttcttaaatgtatgtggaacattctccaggataaaccacaagttaggccataaaataattctcaataaattaaaaagggctggctgaaatcatactaagtatttctgagggaagagagagaccctctcatattgttttatattgttttatactcagtacctgttttaagaaaaaacaaggaagtgaaaccaaagacaggcagcctggtgccaggcccaaaaccaggcctgggcttgcctggcctaaacctagtagttaaaaatcaactcatgacttagcaaccaatgttatccatagattccagacattgtatagaagaacactgtgaaactccctgccctgttctatttctctctgaccaccagtgcatgcagcccctgccacgtaccccttgcttgctcaaatcaatcatgaccctttcatgtgaaatctttagtgttgtgagcccttaaaagggacagaaattgtgcacacggggagctcagattttaaggcagtagcttgccgatgctcccagctgaataaagcccttccttctacaactcggtgtctgagaggttttgtctgcagctcgtcctgctacgtttcctctgaccatgatggaataaaattaaaaatcaacaacagaaagaaatttggcaaattcacaaatatgtggaaattaaacaaaacactcctaagtaattaatagatcaaagaagaaattataggagaaattagaaaatattttgagatgaatgacaatgaaaacacatcataccaaaatttatgaaatgcagataaaacagtggaaagaggaaactttatagctgtaaatgcgtatattaaaaaaggagatccccaaatcaataaactagcctccaccctaagtcatagcaatcccaaagccagacccaaagccagcagaaagaaataataaatattggagtagaagttaatgaaatcgagaatttttaaaacagagagagtcagtgaaaccagaagtttgttctttgaaaagattaacaatattgacaaaatctttggctaaactgatggaaaaaaaagagaagactcaaattactaaataaaatcagaaatgaaaagaggagacattattgctgacttctgaaaaataaaaaggattttaaaggaatactgtgaacaattgtatgccaacaaattagataatctagatgaaatggaaatagatttaagtccctagatctggcaatgtgtccctagattaggcaatgttctcttagatataatctccaaagcacaagcaacaaaagaaacaatacgtaaattgggctacatccaaattaagaacacttgtgctacaaatgataccatcaagaaagtgaaaatacagctcacaaaatctacaaaaggggagaatatatttgcaaatcataaatatgataagggacttgtgtctagaatgcataaagaactcttagtattcaacaataaaatgacaaattccgcaatttaaaaattggcaaaaatttgaatacacatttctccaattaagatatgcaaatggccaatgagcacataaaaatgcttaacataatttaaccattactgaaattcaaatagtgagacaacatttcacatccactaggattgctagtgtgaaagttaattattcaaattgggtcattcttgtcatacccaaataaatcagtcaagggggctacggggaaaaagccctgggagctcgtagcacctgctccaagaattaaatcttccacaggcccaggtgcctaaatggcctgctgtaactccaagaacagctttacctagcagctgctgaaacaacctgctgggaccctaacactggttttacttaccaccatcactcactaatcagagctagcaagaagcttgctatctcccaaaagcttctctagtgcaaatgaacttctttcaaaacaatacagaatatgtctctttctaataaaatttccaacattctctttgggacatgctgaggaccacttggtctgtgtgtgtgccctgaatcgcaattcttgctttccaaataaaacattttaaatgtaaagattcatctctattgttcattttacttagacactataatcaacaaaacagacaataacaagtattgaataactcagatgtgcagaaattggaaccctcatacattgctggtggaaatataaatcggtacagccacactagaaaaaaaaatgggcagttccaacaagttaaatatggaattatcctgagagctatcaattccactcaaagtgaattgaaaacgtgttcatacaaaattgtacatgagtgttcacagcagaattattcataatagctataagtaaacaacctaaatatccgtcaactaatgaatgaataaacaaaatgtggtgtgcctatacaatgtaatattcccgctataaaaagaaacaaagtagtgatacatctccaacagtgatgaaacttgagacaagctaagtgacaaaagccagacacaagatgccatatattttgtgagtgcatttatatactgaaaggggaaaatcaatagtgacagaaaatagattagtggttgccataggctggcagcagaagcaaattgggagtaagtgctaatggatatggggttcttactggtgtgaaaaaagtgttctgggattagacaatgataatggttgcacaattctctgaatacagaaaaaattactgaactgtacactttaaaatgatgtatttaaaggcacgtgagttatagctcaattttttaaaactatgtgtgagtgcttatagtgggttcatttttttataagccaagtaaggaagaggaggggcaagggaagaaaagagcaggagaacaacttcaagttccttaaatggggaatggataaacaaacttacacattcatacaatggaatacccttcagcaatataaaaaagaatgaactactgaaacacaatgacatcggtgtatatcaaactcattacacgaagtgaaatagccagactcaaaagactacatactgtataatttcattctatgacactctcggaaagacaaaattatggggatagattacagatcagtggttgcttgtagctgggatggttgtagtggctgactacaaaggaacatggggtacactctgggggtgggtgatggaactcttctattcatagttttggtgatgattacacaaccgcctacatttgccaaaactcacaacattgtacactaaaaaggataaattttgctttctgtgcattatatcttaattttaagatgggttgttttttccttaatgccttagaatccttatatgttagtacagggagtaatttgagtactgcatagtttcacactataaatatattctaatctgtttatctagtccttaattgatggtcactgaggttgattcttttgttcattttctttccttttcttgctgttatagcattgcttcagtaaatattcctgtacttgctttcctatgccatgtgtttttatttcactaagacacacgtaaaatgaaattcctaggtcgagttttgcagaatacggacaactcctggagatttttctgccaagtggcagcctggagccttcctgtacagtgcagtatggggctgaatgctgagtactagtgctcaggttttcgttttgtaagttagttgctttttggtctcagagacttgtctccagcattatttctctgtttggtggattgaactggctgatatataccccttccgtggctcatttatcttgattgccaacaaccctccctttcaggaggtagccgatagatgtgattctgaagctacgcaggatttctttggcagaaatattaatatttttaaagcaatgctggacaaccttagttaccataatcaatggcctgctttactttgcatggatgattgctgcagtgtgtgtgcatgtgtgtgtgtgagtgtgtgtgtgtgtctgtgtctaattgaaaatccccaggaaagagaagcagtggtttcccacagtaatgtaaatactgtattttaaaaatatattgttacctatggactcttgaaactaggagggatccactagactcaaagggaaggaaccacagataagatattcactgtggaattctcaatggctagcagttcccggcatggagtaagtatgccttaagtgttgaataaacaatccctccaggcactcagtctgggccaggctgcctgttcattacagcatttatcctcccaggctttgtaattagacacgacagctcccacagctctttctccaccccagcattctcttccgagccctagagctgcatgtctgttgcctaccagacctctccaccgggatggtccatgtacacctcaactaccatgtgcttaaaactggacatgcctttcccactctgctcctcctccagcatcctcaccttgggaaagagtgggcaaaactgcccacttgcttggccaaaccagaaacctgggcattttccttctatgtcacctcccatatctaatcaatccccagtcctagtgagtaggcttcttaattttctctcataaatgtctcaggaaattgctgactgctatccatcccatgatcacagccacatccagactgtgcccgagaatgactataagcttttcccagctgatctcttaactggtgccttccttaatgtcattctcctattagcaggagtgttatcttttgaaataagcctgattaacccacaacaccatccttggaataaagtcctgactccatgtggcttcccagtctgccatgacctgtcccttgtctacctctccagtctcactccacacccctgtccttcctctccttcaccttcacctaataatctttccagtctcaattaggtatttctttctcccataaacctttgctaccccctaagttgggttatttgcctgccctctgtgcctctgtaatgtctggcacattctagctcttttcacaacatattttgatcacctatttagtcatttggttcttccacatggtgatcatgagctctgtaaggaaagagggcataaatgtgttcttagtcatttggcctccagaagtgactacaatttctctcagtgtaagtaataataaggtagtaattgaaaaaggaggacaaggaaaaagagggagaaaaggacagtagtggagaagagggaagagaaggaggagagagagagaaggagaatggggagaaaaaggtgctcaaaatatttgttgaatgcaggatggatgggtggatggatgagtgggcggatggataaatggatggatagatggatggatagatggatggatggatggatggatggatggatggatggatggataggtgggtgagtggattgatggatggatggatggataggtgggtgagcggattgatggatggatggatggatggatggatggatgggcagatggatggatggatgggtgggcagatggatgggtggatgggtagatggatagattaatggatgcttggcagatctgggatttgaatctctgattggccacttaatctttggaatgtgatgatctttggtgctacccatggatacagagctttctccttcctctggctatctggtagaccacacttcctgcctccatatggtagatggggccatgtagctatttattgtcaagagttgtgagaaacgatctatatcacttttgtcccagagaagtctgaggtcttctaatgtttctttctctcttacatggcaactgacaacactcgagatggtggttgctcccatcagcctgggtcttggaattctgccctctcctccttctctttctcctccttttcctccttgagtacaataagcagaactccgcttccaatttgctgtgaatatacaacatgaatgagaaataccgtttgatattttaagcaattgagactttgctgttgcttacagcgtaacccaacctatcctgattgatacagagtctgaaagaagtgattagcctttgtgaatcaaaatcttttctgtaaatgagaataataataatacaaccataggattgaataaggcaattctatatggtacataacccagcacctttgctgctccaccctccagggctttctctccaaggggtgccgtcagcccaggttacccttgggaagccagtctcttggttccgaatcctccaaaacttctctgagatatcaaaactctccttcctcagcttcaatcaacctattgttatgtaccctctgacccctctttccctagcctatcaattttatctgcttttgtccagaaactagctcttacatcaccctgcattcttctaaattttgttgtttatgtgatactttttgtgtattgagtccttcaggttttgacccttaatgttcaacggcaaaattttgtaacttcaacaaaacacttgcttttacaattgattgaaactttgtctttcacaactgttgtgttggctaagagtataaaaataatgtacacaggaacacaattgacaacttcgttttctcaaaggttggccattcccctgaggctgtaagcctctgtcacctagtacacttttagtgttagaatgattgtgggtaaaaagtaattatctagaatcaaaaaatatatgtgtcaatacttcaaaatgttctcctcacatcctattttggagcagaagaataaataatgttaactacactgagaacctgaacgctgaagctgccatggatatctcagagggccgttcagctgccaactccatctctgagtctgggccagtgggactaaagtctcagaaggacctggaaaatatcgggtctttgccttcattagtcatatgggcacctctaccatctgtggtcactacatctgccacatcaagaaggagggcagatgggtgatccacaaccaccagaaagtgggtgcctctgagaagccacccaaggacctggaatacatctacttctaccagagagtggccagctaagagcctgcccttacccctatgtagcctgagggcaagggaagaccacctagcatgaaggagaggaactgagggatggacttcagcccccctactctgtagcctttttccttttgtccccagcagcaggaagaagctgcaggccatgagagaatgaccaggcaaagcagaggagcagtcaatagactctggggatggagcaggaaggggacaggagggaccaaccactgatccataaggagactttcttgcttcccctgcccccggaatccatagtgctctgcttctctccatcaccctgcctagccccctggcatggagggaagggatcttgtttgtgtgcatgcatgggtgtagcgtcgtgcatcctcttccaggggagggagaatctgtgccttccctcctgctttgtgtttgccctctgtgtggttgtacaaggagggggtgatatggtttggctgtgtccccacccaaatctcatcttaaattgtaatctgaattgtaatccccatgtgtcaggggagggacctggtgggaggtgattggatcatgggggtggttttccccatgctgttctcgtgatagtgagtgagttatcaccaggtctgatggctttataaggggctcttcccccttcgctcgctctctctctcctgccaccatgtaagacatgcctgcttccccttctgccatgattgtaagtttcctgaggcctctccagccatgttgaactctgagtcaattaaacctcctttctttataaattaccccgtctcaggaagttctttatagcagtgtaaacatggactaatatggaaggatatgaggaaaatggggactccccttgcctttctacctcagtctttctgccaccctgtctcctgtttgtccttctctggaaaatgccaaaatacaaaatgtgaataaaagtgcaatggctaaaattaataataatagcatgagctccacacacacataatggacagggaagcctgatgcctgggctaagatattcagttctgatgacagtcatcacaatagcaggtccatttcttattctgtcttcaatcatggaagaaaaatttaaacttgataaaatttaattcactgactttttttttcctaagaattaggatatgctagagatatgtaactgcaaggcatagaaaactactcaagtgagctcaaatacaaatggacttactgaaatggcagtaggaggctcatggatatcaggcatagggagtctctgagactgaaaggtgtccacttctgctgcccactggctcatgcgcagacgtggtggatctgtggttgagggcaaccctcaactcagcctcttggatcaagtggttgagggcaacactgagggatgggggaataattagacagaggaagcctgcactccagcaactttgcagagtacagctcagcaaaccaagttctccagagtgtggaatgaacagatgtgctgccccagtcggcaggtccaagagggtattcatgatgataacacaggctcacttggaatgaatgcatcagtagattccccaaagtgatgatattcagcttgggaaacaattagctaattagcatagtaatccatcactggaaatcaaggtcatcgccctgggattctgtctcctgctgccaggcctctctttggagagaaggcaggatacccatgaaacctgcctgtgccccattaagtggcagggtacccctcccaaggcaatgcaaggtggagcccctctggcaatgccaatggctcaaacactcatgctcatgctcacccttctcaaccaggtgatggcaagattggtttacatgtatggaatgtaagacaaagagctccctgtggaggagctgaggacagtgatgatttgtggtggcctggatatttacttggggcatctgtctttaggacaccctgagccaaagactgggaagtgggtcaggcaggctgtatgccttaaggtcactgaaaagatctaggacttggagctcatgaacaaataaaaaaagtaagtcaattaactattaaactaagaataataatagccttttttgagcatggctatgtgcaggtactgaaacaggcacttttatttaatttcatgacaaccctatgaagtaccatcactgagctcactttacaaatgaggaaactctttgaagtccaggtcctgagatgtttcctctttaacacctgggagcaggcatggccatgccacatgtcaaatctcagcactgtgtgttcataaaatgtggaaaattccatatgcctttggacatccttcttcaaccagagaactcttttttaaaaaatctatatgccaggtataaataccacccccgcctcccacatgcagatatcagcacaaaatatcacacttagaaaataaaattttaaaacgtcaaatcagatccggctctgagttgctctcataaaagtttctgaaaagcctaatatctaacactggaggattccctcccacctccttcagttaaaccagaaaccccaaagcttactcagaccctaaaattgggagagagatctgcactctcctctgtggtacctgtgttcactattctcatcctcagtggctgtttgtgggaacagagtccagccatcctccactccaggacaccctaaatcagcccctttccaagctcaagaccactccatgccccttctcaaagctcagaaataggctatttcttttatgagaagaatcagcttagtcatgaaaaacacaaagttattaaatctctttgaggcaagagagcctccaacttggaactgaaagcctggctgcccatcctattggtgtaaggatggacaaattccttttcacttttcctgaagagtcctcagcagtcgaagaagccagacatcaattaatttctcaaacactccttcagtcacatctgtattacccaccgaacttctttgaacaaagtatattgtagcaaaaaatagaatggttgaaactggggcccactgtttgcatcttacagatgagagtcagagatgaagaattactcccaaggtctctgagctaccagagaagctcatcagtcccaagtgttgccagattctaggctcaaaaacccaacaattactagatactggtttctaaaggtcaatcccactaaaagaaaccaaggctccttggaagaatgactggtccctaggtggagacagaaaaagtatgacatgggcctataacatctaattgtgtctgagaagtaagtaagtgctcaaaaagaaaaatgatgggagcatataaaaaggacacagaacccaacttgaatcgatttgaatggccagatttgacaatgtgagcattagaataatgattcttgttgcgatctcaattgtgtccccaaatacttatgttgaagccctaatccccaagatgatagcatttggagacggggcctttgggaggtgatttggtttagatgaggtcatgagggtagggccatcgtgatggggttagtgcccttgaagaacagacacaccagagagcttgctacctctttctccaccacatcaagacacagtggatggtgtcacctgcaacccaaccatgctggcgccttgatactgaactttcagtctctagaactgggagaaaattaatttctgatgtttaagccacccagtctatggtattgtattatggcattgctagcagactaagacaatagtaagactgtagttcattgaataaaataagaatccaagagttcatacagataggaaaggaaaccttttttttctcccttggtccagagagagtatttctagactcttcttggaatatgtccatccctggtagattgtgagatgtaatcactgatagttctaaagtaacctccaaggttgagaagctgggagatggagaagttgtcaacctgacctaaccactctgtgtgactgttggcaaggttttcagaagaaaagcagagtttttagagcaaaaaaaggccagggtgggtgtgaggcaggcaaaaacaatagatgtcaactacatcctgccctctgactgtccaacttccatataccagtcttccgacaccctcaaaaatgcctgcacctaacagaatgcaacaaatcatgttcaaccaaacactgccctctctcctaccccaaagagagacaacctaaagtcatgttcatatccatatccaattccacaaaatgggcaaatttcactaatctccattagatctgaatgtagtttctcgaggttcagcaacctacaactgaactcctcccccactcagcctatctcttgtacaacagtggagagagaataaaaaagaaaaattgcaagaaaaatccctttgggaaaagaggaaacaacataagactgtcacttcacattatttagcttatgcatagcctctaggagttcctcctggcaatggatgagttccttgcttagccatgtttggttgcccctgtttctgctctctggggagatccccctcagctgctgacctttactgctggatcatgaaggttgctcctttgacagttacatgtctttggcaatccaattcttgttggtgtaggctcaaaacttcatcattgtcttgggggttgagtaaatcaggcttttaattcccatgattgggatttctctagaagtccagtaaattgcaaactcattaagattctggtctattatgtctggacaactccatggaccagcacccaaagctagaagtctgtttgaagtctagtctttgcctgcaggttgtgcacagcttgggaaattctacagattagaagcaggcctccctctgttccctctcaaccccaatcatccctcaacaatgtggccaccaccttgtttaggcaacctaacaaacaaagtgtagagaggtgaactttctcacctgctctgtgcccaggctaaatcccagtgatgtctttttctggagcaaatcttaccctggtggttggcacacatgggacatgagattgatacttggaggggttggagtgtgaagtggatgtcatgcttttccaggatcctacatgtcttgctctgtttctttcccccaaattaacctgattaaggaatagagctggtttttctaattctgtaaggagaaagattatctgactgttggtcaacttcgattattggccagagaccaaataaagcctcttgtaggaaagccagattttattctttctcaccacttggatgtgccagctcccatcaaagctcatctctttcttgtaaggatttactgaagtctgtaagaagcagccagcatgctccaagatcctttttcctgccatatctcttaaagttcaataccagtcagcacggggccccagcacggggccccaggacacgcaagcaactctcagccagctaatttgctcctgcataacagggaaggccaacttctcacctgcagttagagaaatcctcgtcactctcgcactagtcccattcagctgatccttcattccaggttctatcacttgcaacaccccacttctgctaccaactttaacactgagtaagagcttttggttgcaggagacaaaaactctaatttattttttctggtaactgaaaagtccaggggtagatacgccttcaggccccaaaggatccagatgctcaaatgctgttattggaaactctctcttcatctctcagctctgcttccctacaggttggctttggtaggaagacggctgctagcagtttcccatttatagcctatcaggtcagcaacttctcaggcagaccgtttctctttccagtcaaaactccaaggctcactctcattggaccaccttgggatcatgtgtcctcccctgagtaaaatcatccatggtgatggagaataggattagccccagctaaaccccttggacagagagtcgttgacagggaaaactggagcacagtaaccagaggagggagaatgaagactggacaggcacaaacaacacatgcccactataaggtgccaggcttacatggtagctgtacttggagagcacaaaaagggagggaatgaacacttttggaacatctactatgtgtctttcttctgcttattttttcaacataaaatttttagcacctattattacaaataatagtaacagctaattcatatatatcctttttgtttacttggctttacactattaattcatttaattctcacaaatccacaaagtgagaactataattatcatcctaattttacagaaaactgaagcacagagcataagcaaattgttcaagattagacaccatgagttgtagagtttaatatctcttttcatttcctggggctactgcaaccaagtatcacaaactgggtggctgaaaacaatagaaatttgttctccacacttctgaaggcctgaagcccccaatcatgatgtcagcagggctgtgcttccccaagaatctgagtggaacccttccttgcctcttccctgctttcggtggtggccggctggccttggcattccttggcttacagtggcatcggttccctctctgctttcatcagcatgcgttgttcttcctgtgagtctctgtgtctcttctcctcttcttataagtcattaatcatatgagattagggctcaccttaatgatctatgttaacttggtaacctctgcaagatcctacttccaataaagtcacattcaacaggttctaggggtttggacttcaacgtatcgttttgggacatgcataacagcacctaggccagactggttccaaatccttgctcacctctagccccagtccaagagacagctactgggtcccagtggtgaggaagccaggagcctatcttccagggactttcagggtgtagggagatgtatctggtatggtaagcaatgagtgctccaaggagggtgggcacagaaaccgagtacccactgagccccagcaggttctgaaggaagggatgtcttcacggagccatgaaggaggaggaggatgcagcagaaggagaaggagatgggagaaatatgctctaggaggaagggacgccatgggcaaaggctgagggtgcagagggaacatggcttgtttagagaggacaaattagttcaaagagatggcaaagagagaaatgaaaaagaggagttaagaggccggagggagggcagaactggaagggttggggcagccatgctgaggagctcagacatcaagatgtcaggatatcatgtcctaggtgatgtgaggagcatcacagggcaagtgaggggctcaaacagaggcactgagattacagtccagtcctggctgtcctgtgaggtcagtggtattagctccattttatgcaatgtagaaagaaacagaggctcctgagattaagttgctaggtctgggcagaggcaggatctgggccgagctctcgccctgcaaggttcccaagggactcaacttactccaggaagcagtgggacatgaggcagtggcaatcgccagcccagatgctgagttcaaggcctgcccttccaatcatgagctaggtgacattaggaaagttgctcctcctctccgaatgcagacaccttcccctggcctgggctgccttgcagggctgctctgggaagtaaactatgtgatgggtgctaaggggctgggaaaatcaacatgcagggagacaggagcaggctggagaccacgtgatcactgtcgtcattattgttgttgttctgcaagatgatgggatgtggctgccctgggcaggcagagctgcaggaagaagtatcttacaatttgcttcctgcatcaccaccctgccaccctccccagcagagctgcatgttcccccattatttcctcccagtgcatcaggcactttaattaaaacgagttcaccagactctttgaaggtgcagccaacaaaggaaacaaaaacagcaattgccttctggggatggcgcctgaagatttgcaagtttcctgtgaagaaaagcaagtgtgggtggcatggaaggttttagctggggctttggggaggagacactttcctcttggcatgtgggagaagctggcaggcatgcagcaggggttgggattgggatttctgagggggatgtgggattcctgagggtgagcattcacatcccagctcccagtaaaggtgttgggtccaggcctgggatgccagggtagagggggctgtcatcttccttagagagcaaaacgagcatggctgcatttgaaatggctctcttttgtctgcttgggaaacgagggctttattctgttagaattgcctgtgctggctcccttgctggagcactttgtctgttccctctgcttacgtgtcccaaaccagtcatcctcgaggaccacaaagccagcctagccccctccagctctcctgcaccctagctcagcctcaaagatgagctgtgctgtgaatggactatgccagtgcttgtcaacagaaacagaatgcaagccatctgtacaatgtaaaatgttctagttgccactttaaaaacattgaaaagaaatgggtgaaattaattttaattatattccctttagcccattatatccaaagtattgtcatgtcaacatgtaattaatattaaaaatcattaatttttttagactaggtcttagaagtcgtgtattttacacttacatctcagcttggacttgccgtgtctcaagggctgagtagccgcatgtggctgatggccaccatattggacactgcagtctgcactttgttttaatgctgggtgtggccttgtttccatttatcaacttggttcattttcctcctgtggaactgtggtccaggaaggtatattcacccccggggaccccggcacaatgcctggctcttggtaggagcttagtaattgctttggagtaaatgaatgattgcatgtgagggttcctctgctctcacattaagaaatcatgctagaaaatgtggacatttaattctccaagtgtagcaatggccagggcatcctgctcctagtgcccttttctttcccaagctgcagaaacccggcaacagtgaggaaactggggccaacaggtgagcttctgtccatctgaaaatcactcattataactctcagccctgatgggtgtgcatggacaaaggaaagcaagtggggccattgaggtgggcagagggagatgtttattttctgcattcttctgcctactttcatccatccacttacccagccatagatgcttatgagctcattagtttattcattggtgaagcattctcagagcactccatttaagcccagcgtctccaggtgctggcatgtttcgtggataaagaaaaagccatcctgcctctttctctgtaatcctctggtgcacttgttctagcagaatatttgttaaaactagaacaaacataagcacatgagcaattcctgcacacataaccttccttctatacttctactgatagagtgcctactctgtgccaggtatggcgctgggcactcttaccaccatttcattcagccctccacttttacagatgaaaaagcttggctcagaaaggctaagtcgcttgcctgatgtcatcagctaccagggtcagagccaagatgcaaacctgattcttcagcctcccaaataggcaacttttggccatacttcagctgcttgtcactgctgttgaaactctgccactctggccaccccttccaggcacacagtgttcagcacatcgtaggtgttcaggaaacacatattggatagatgaatggaatacctgctgaataaaagaatgaataggtgaaggaatagattaattcttcctcactttataattctttctgtttttgcattggtctgactaaaatatagatacaatagcatagaagacattgggactttagactcatctgggtctggattcaaatcctggatttgcccatatttgctcagtgacccgagcaagttaacctttctgaacctccattttttgtagtttactgtccatcttgtgtgtggcatagtgtgatatgctcagtaaattcttattaaatttgaattgatttaaattgaatcaaattgagttgaattgcaatttcatagcagagtcctagggagccctagaaaagagaaggcttaatttggattgggagaaagatgagtgggcatcagactcacctggaaaacctgtaagatccatattacacagccccccttccggagaacctggttcaggagaaatctgtgttttaacaaggtcccctggtgatccagatattcagatactagggtccagggatcaccttttccaaagtgcaggtgggtgggacaccctgtagagagtggtcagggaaaaaaaatgtgtcttactgagtgagtggacacagaagggagtgttggggccaggcctcgaaggacagcaggatttcctgtgcatgttgccatccctgctggcctcaactgcttctgcctgttagaaaagggtgggccatgggccatgtccaccccctgtgatgtgccttcaataatgtatgagatcactcagcgagaagctcatgaattcttaaacccttttaagggcttcccagggaggccagtcgtccaccccaaggcctctgtggacccctgccttcttcatctgggccccagatgaggcatagtgacaaggtcctgcccccctgctatggccttaaggctaagagccttttaaggaacggaatgttccttctcacagatcccaagttctctgcacacatgaattatgtatctagcacttggcgtaacagcactctggaaactgttccaggatcccaaaggtgcagtccccgactccatccccgcaccacactgcccaagagcatgcaggtggcccggcccgagactcagctccaggtccccctcctctcacctccagccctcaccagctctgtgtggctgagttaagtcacctcgctgctcctggtctcagagcgggataattaggtgtccttgcctgactgctgtgagcatgggagaagaggatatggaggaggctgccggttcagctcctcgtgcagatcaagagctgccaacacagaagctggtgctgttttccctgttactcttgacagttctcccgacacctccgtatccccagggagtggacacttgtcccatgatgagtgtctgtcacgcagtgggctgtgttacaggagggcaacacagagcctcaaggattcagcgctttgaaggtgagcagtgagcgagtctgctctgtgtccacggggagatgtgaccccactctctccaggtgctcattaaaaacagaatccttacttataagtgggagctaaacattgagtacacatagacataaatatgggaacaacagacctactagtgggttgagtggggatggttttaaaaaaaaacacctctccaggctgggcctggtggctcacacctgtaatcccagcactttgggaggccaagacgggggaatcacctaaggccaggagttcgacaccagcctggccaacatggtgaaaccctccctctattaaaatacaaaaattagctgggcctggtggcaggcacctgtaattccagctactcaggaggctgaggcaggagaatcacttgaacctgggaggtggaggttgcagtcagccgagattgtgccactgtactccagcctgagcaacagagtgagactctatctgaaaaaaacaaaaagcaaaaccaaaaaagctacctctccagtactgtggtcactacctggggatgggattcatactccaaacctcagcattgtgcaatgttcccatgtaacaaacccgcatgtgtacccctgtatctaaaataaaatttcaagaaaaaaaaaagcaatcctgaaaagtagcccaggaaaagagtcactagaaccttgccttcttgccatcacctgtaacaccctacaggggatgatcagggcccatctcaggtggcttctcccaacaagtaaataattttaaagtggagaaatgctatgaaaaacacaaaatattgtgctatgatagaaagtggtcaattacttaagctagggtgatcagggagggcctcctggaggaggtggcttttgaaatgagatctgagccatcagaagaaggatctagagagaatcccaagcaaaaggaatagaaaagactaattccctagggagaaagacactttgcatggtgtgctcctgggacagaaagaagcctcctatgctggagtacagtgaactcgagggttggtgggctgagaatgggtataaggaagagaagagatgaggatgactttgctaattcccccaaagacccttctgggggaattagcaaagcatcccttcctctgggcagacacatccccttatctgggcatagcttccatgagggcagcatgaattttaggccctccctacttctccaccaggtgcccttgtgcagtgcacaactttcagaatcatacatggaagacttgggtagttccattcattacctgcctgtgatggagccaggtgggtggggaaatcagctcagttctggccaggctaaatgtgagatgccatcagccactcaggaaacggtgctgaggagacagtggaatgtgcccctgaagctcacaacagaggtctgggtgtccttagtgggtctttttatatgcctggatgaggtcactcactcagagcatgtagggtgatctttctaatgtgtatatctgcctgggaggtgcttaccagatagtgggtgatgccagcaaggagccaaggaatcaatatttaaggaggcactcactgtcaggctcccgccaatgtagggtttgtgcctgagagtgagtggaaccttaaattttgtgtctccttaagtctagccccagtcctgggtaactgaacagataggatggtgcttacaacaatagtgctggtataattgcatatccctttagggaaaaaaagaaccttaacctttcattcagaccatacataaaaacaaaaatagattagaaccctaggcataaatgctataactataacacttttagggaaaaaaggagaagcatcttcgtggccttgaggcaggcaaagattccttaaataggacacaaaaagcatggaccatgaaagataaaaaaaaaaaatcaataggatttttatcaaaactaagaactttgaaaaacactgctaagaaaatgaagaaaaaagacacggactgacgtagctaaatgttgatgaggaagtgatgaaaaagaaacccttgcacactgttagtgggaatgttgactggtgcagccattatggaaaaaatatagattcttttaaaaattaaaaatagaactgcctcataacccagcaatctctcttctaggtatatatagaaaggaaatgaaatcaccacatcgcaaagatacctacacgcccacattcattacagcaccatttatatagccaagatatggaaacaaactacaaataaatggataaagacatcgtgtgtgtgtgcgcgcacatatataatggaatattattccgctttaaaaaagaaagaaaccctactatttgcgacagcatggacaaaactaaaagacattatgctaagtgaaataagccagacacagaaagaaaaatactgtatgatctctcttacatacgtaaacttttaaatgagcacgtagaaacctagtagaacaaggattaccaggcacagagcttggaaatgggaacctgtagatcaaagggtgcaaagttacacttatgcagcatgaggaagtctagagatctgacggcaagaggactgtggctcatcatatcatattgtatgctggacatttgccaaaagagtagattttagttacttttaccataaagaaagcacaacagaaagaaagaaaagaaaaggtaactctatgggatgatgagtgtgaatttgcttgactgcagtaatcgtttcactatatatgtgtatatgaagataaatatatcaaaacagcatgtcgtacactcaaatgtatacagttaagaagccagaaacaatgaaattaataaataaaaaaaattttaaatgaaaaaataccatggattgagagaaaatattgcagtgtatgtatttgacataggacttgcactcttacaactcaataataaaaaacataataaaaagacaagtgatccaacttttaaaaaataggtgaaagataagaaaataaaagaatggccaataagcacatgattcgatgctcagcatcatctgtcatcagagaaatgcaaatgtaagccaaaataaaatactggtttacacccattagaatggctaaattgaaagcaatgaaaataccaagtgtggcagagaatgtggggcaactggaattctcatacacggctggtgggaatgtaaaatgtacaaacactttgtgaaactgtttggcagtttcttataaacaaacaactaagcaaacaaaatatccatataaattctgacacacaaatgttcatcggtgctttgttcataatagccaaatacttggaaacaaccaaaatgcccatccacaggagaattaataaatgagctgtgttatatgcacacatcagaaaactattcagcagtaaaaatggaactactgatacaggcaacaatgtgggtgattctcaaaaatatcatgctgaacaaaaaagtcagacgaagaaaagagtgcagttgtactattgcatctatagacattctacaaaaaaggatataccaatggcaaataaggatctgaaaagatgttcaacattgttagccttttcttaggaaaatacaaagtaaaaccacaatgagatatcatgtcacacctaccataatggctaaaataaaaaaaaaaggacaatgcccatattagtcaaagttctccagagaaacagaactagtaggacattcctagagatatataagaggaggtttattatgaagagttggccaagaagtcccagaatctaccatctgcaagctggagacccaggagagctggtggtgtaattcagtccaaatcagaaggcctgacaatcagaggaggccatggtgcatatctaaatcccagtctgagagcaggacaagacaagatgagatgtcccagctcaggcagtgaggtaagaaaaaaaaaagaaaaagagaatgctgccctcttccagatttttgttctatacaggccctcaataactgaatgacactgatatgctttggctgtgtcccaacccaaatctcaccttgaattgtaataatctccagtgtcaagggcagggctatatggagataattgaatcatgggggtggttcccccatactgttctcatggtagtgattaagtctcacgtgatctgatgattttccaaatgggaagttcccctgcacaagctctcttgcctgccgccttgtaagacgtgactttgcttctcctttgccttctgccatgattgtgaggcctcctcagtcatgtggaactgtgagttcattaaacctctttcctttgtaaattacccagtctcaggtatgtctttattagcagcgtgagaacagactaatacagatacccaccctccttggggaggccaatttactgtactgagtccactgattcaaatgcttaccttatccagaaacaccttcagggacacacccataaataatgttttatctgggcacccgatagaaactgattcataaaattaactatcacaacaccaaatactggcaaggataaggaaaaaccactcctacgttgctggtaggaatgtaaaatgttacagccactgtgaaaaacagtttgacagtttctttgaaatgaaaactgtaactaccatatgatcctgggcctttatcccagagaagtgaagacatgtttatacaaaaagccatacaccatgtctatagcagtgttattcacaacagccaaaagctagaaacaaccaggatgtcctttgacaggtgaatggttaaacaaactatgatatatccataacatagaataacacccagcaatgcaaaggaacaaactattgatacaggcaacaatctggatggacctccagggaactatgctgtgtgaaaactgctgatctcaaaagagtataaactgtatgattcttttataacatccttgcaatcacaaaattatagaaagggagggcagatgagtggttgcccctggttaaagagtgggtggggcagggaggaagtaggtctcgctgtaaaagagcaaagtgagaaatgcttcaccatatcaatgtcagcatccttgggccgatattgtactctaattttgcaagatgttatcattgggagaaactgggtaaagggtacatgagatctctatattatttcctacaactgcacatgagcctataatcatctcaaaataaaatctttaagaaaggcaccatgaaatgatttcagcaagagatttgcaagatctttatatagaaatactaaagaaaagttaagcatataaggagatatggcatgttcttgaagaaaatatttgttatctgtaagatgtcaattatccccaaaaaagttaatagaattttcttcaagtccaggttatttgggggagctgacaaggtcaccctaaaatgtattcagagagcaaagagtgaaaggtagtaaggaaacaaagaacgcattgaggaaacttgctctcccatacatgaattagcatgaaattagagtaactaaatcagaatagcattagtattagacagatgaacaaccaatggaacagaacaacctagaaacagactgatggctaaatggacacctgacaaatttggtgttgcagatcaataggaaagagctgatctagtcaatatggggttggaataattgaacattaatatgagaaaaataaaattgcttccttactcccgcctcacacacaatatatcagttatacgaggctgaaatatgagaaaagtatttaaatttttactaaaatactacaggacaatatctttatctttatggtctcaagttggcaaagaatttattaaacaagggctaactataaaagaaaatattaataaattttgaccaaattaaaattatttacttctgttcatgaaaaggtataatagagtgacaagaaatgtaaaatgaaagatgatatttaaaaacctataactagcaagattaatatctaaaacatatacttttcctgagtcaataaaaaaataagcaaaattttaaaacaagcacaaaagacctggtgaaaggcatttctcatcaaaggaaatgaaactgatcaatagatgtataaaagatgcttaatgtcattagtaatcagagaaatgaggatcaaatccaaatgaaacactacttcatcatatcatatttgcaaaacttaaaaaaaaatcctaacaatacaaagtgttggtcaattgtggagcaataaaaacccatgcctactataggtaggataataaaatggatgaagcctccttggaaatcagaaactggaaagcaatgggcatcaattagtaaaagcacagatgagctgaccacaatacccaactgttccattcctagcgtattccctgaggaccccttgcacctgtgcatccaaagacaagatcgagagtattcacagcagcatttttttttggcgttatcagaaaacctggagatgaccaaagtatccatcaaagggctagtgcatcaataaaaactgtgataaggacatacaaatggaatattgtgtagcactgaaaaacaatatacgtcaactacacaaataatgctgagaaaacaacaaagaagacatggaagagcaaatttagagcaatttaatttttctacaaagggttaaagcaggtaatctataaaggtaaaactataaagaaaagcaagagaattgacaagagtgaatactaaataggatggaggtgaccctggaaagggggcaggtaggagatgcctttggagagatacacagtaggacttcacgactgttttttattgttccactttttaacctatgcaaggctatattatttttcaaattgcacacacacaacctatacgcccttttattgtgaagtatgccgtgtacataatatttcttacagcagacggggagccctgggcagttctgggcaggctgctttgctattggccacaggaagggtgggaggaggtgggcggctcttggcatggactgtttgggcaggccccgtgtggactaggctgggaggtggcaggaatgatgggtgtggtgagtgcagtactggctaaaaacagggagggaagggagggccagggaactggagggtttagagaccagaggaggaagggaggaggcaagcatgacaggaaaagtgaaaagagaaaagaaagaaaaaagtggggggaaggggagagaaggagagaaggaagaggaggaagaaaaggagggagaaaggaagggaaggaaaagaaaagaaaggaaagttacaggaaagataacactgaaagccttctgtaggtcagtgaggttctggtcccattcccatagccacagtccctactgggcccccagctgccgggggaccttgaacaaacccctccatctccctgtgccacagcttccttgcctgtgacaaagtctgggagtcccaggctgcccctcacagaggctcgtgatgaccatgagtgtaaagtacctggaagagacatcacccaaagggaccagtcgtactcactgagactccttagagtacagctggttccctcccagtgagcccccggagggcaaagcctccacgtgtcaccaagtctgtggtgtccaccacacacacacacacacacacacacacatacagagcaatgggcccctgtgggcgtctcttctgttccccttacttgaactgtggcacctgcatgattttcgatactggtttgagctgagagccatggagtacccgctgtgcaacctgagcaccgtgcggtcctcgaagacaccactcacagcctcgtctctattggatgattagccatgttagggctctcatttattgaggacaccgcgtgctatattccctatctcatttaattattcggttctgtattctcttttcacagatgaggaaatctaggctcaaagacactatcttgctcaagctgcacaacaaagcagggctaggattaaacctcgttctgcccagatgccgagccgggagtacaccggactctgggaggagcgttggcgtggaaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacgtggaggggcgccccgtccgccgagccccgccccaccccgccccgcccgcccccgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggtggggcgggctgcgcgccccgcacccccgcggctcgagctgttcccgcccgggcccctctcgttggcaggaaggctgcgaggagcctgggcagcccgagtcgcccccttctgcccatcccccactgctgtcccccttctggggtcccggagccctccaaggccgggccagctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcgtttgtcctgttttgctttgtgtagagtctgatggagccaccagtgcccagcgcggccagaacccccccacccccctccccgacacaaacaggctcccagtggccggaaaaacaaatctctcacagcttgaattttcctccggcagaatgccctggagttctgagcttgggtgatgattctatttctgtgccttaactctcttgagccagaacaaagacaaatcccggatttctccatcagtctgtgaccctagagaagacccagagctggctccagggaagggctgcgtttggcctgggagagtaagtcccaatctaccaaagccacatcttgcaccttctctggttgtgttggttggttatggtgggagcagagaggtcgggaggccacccaggctcccttctgtctccagggtgtgtggcagggaccccatctgctgctgttttcttttacagggaacgaagtttgaggggacacttgctttttccccaagcttcacctgtagtggaagcctgtttaaaaagtgacagcaaaatccagactgtgtgtggacagcgagtctgcaaatggaggcttaaaagatgcggaagccccaagttagttctgggggtctagatcctggctctccggcagccccttaagttttccatgatgctaattgcccttctgagtatcgctggcccttttttttttgcctgattttacatctcctgtgcctaaatccatacttataaaaattgtcatgtaaacatcattttagataatgatggttttagctacatgaaaactaaggaggctttccaggatttatttctagactggagaagaactgtgtctgccttcccctctggatcccactgaacctccggaatttccatggttaacaagataaactgatccctgctaaccctggagctggctggagcatcagttgctgccatggcaacttgacgaaataaatacagggctttttaacgtcttcaggcagaatctgcccagagaccaggttcctatttttccttttttgtttacaattcacattccactcggtcaatgtattctccttgacacatttttgacactggttacatgcgcagtactgtgctagctgcaaggaacagaaacatgaagtaccacacatatgagaacagacgctaaggtttgttgagcacctactatgtgccagacgctgggtgcttggcatattttatcacagcaaatccttacaagtccatgacggaggccccattttacaggtcaggacactaaacgagattaaataatttgcccaagagcatgccatttgcaaggaggagaactggatttcacatctgggcctgagtatctgcaaagggttttccaccttattgcttcatcctgagaaagatacgatgtaaggtacaggacagatctatttcagaatgatttctctcttctcttccctctgggaagtgggcttactattgtgcctttctagtagattgctttctgctgttgattcatcccattatccccataaggatgggaactgttacttccctacctgcaatacttcgcagtgcttggctggagcaagtgctcagaccctgctcctggtgtgtcctgtggccaccaggtgtgtgtgacagtcactgtctctctgtgcagtctttccctcagcagggggcagtttgcagcgaaatgttggtgcatccatccacttgctcagcaaatgtctagtacctgccttgtgacaagctccgtatcaggcactgggacagggatcctgtgggacaaacttgaataggacgtagattttctttctgcatgtttataaaagcttcaagaaatgatgggcccggctaagacacagaggggaatggctaaagggctgggctgggttgaagaaggtgcccagcacgtagtaggtcctcaagtatttattagaggattggatgaggacaagatgtatgttcatgaaaagacattaacaggagaagatggtgaattcaaagtgtcaaatgccaatgccactgaacagctgtcatcatcaggactttgagaatgggggctgaagatggattagaactgtaggcatatatctcctggtgggcctgggagttaagactgttctaggtggagagatatcgagatagcgaagtccagaaaatattcacagagttcttcagaaagctagaggatggggtgcaggagggctgggagacagaggccagggccagattatagaaggtgctgattgctggggtgagaagtttgcatctaatcagtaaggcagtgggagccattgcaagttattgagcaggagaatggcatatagttgaagcagtcccttgggaaaacctcagcccctgtagaggatagaagctggagggattcctggggctgggcatgcatgcttgtgtgattaactaagtcagtgaaaccagatccacgtgactccaagcccacgtttcttcttccccatgttgttaaatgtgattcctgtttttggcttaagaagacccagaacacataagccattttagaaagattttccactcaaaagctaagcattaaatagatatcctctttgggtgtacagagtagacaccagttatctggcaaatcctcttagacagaggtgccctccctggtgcagtacacgtggctgtatgacagtgtaagagaggctgcaggcactgagagtgtgctcgtggaccccatcttacttctgagccctggaggctcccagttgccctctcccctaccctggaaacaccccagccccactccacacagtgcctgagtctctggtgactctggaggatgtgaacagtgaaaaaggccattcatttctcttaggccaggagtggccaagaggacagggccacctggatgtccagtgggctggggacaaggcgagaatcacagtcttttaggactgagtccaaaatccctgtttcattggcaggatcacgcatgttcaaagacagccgccatgcattccctgtctccctcctggacatgcttgctgcccaccacttcaagagctggaatctgattcttctccccttaaatctgggactgtccttggtgaagagaaagtctagtggctttcttggtgaagagaatgcagtattggtgacattctgtggccaagtcctaaaaagccttagcttccacttgggcccgttgggatgctcacttgctccaggggaagcccacatcatccaagaagtgcagtgacacagaggcacatgctgggggaagggagcgaacatttcaggaacgttctgcatgctaagccagcactcattatgggggaatgggatggacaacagagacaggagggctccttcacttgttcttatggcgtaactctcctgttaaagcatgcctcgggtctaaaagctcaaccttctttttgtcttgcactgtcccgtccctgcagtgagtggtttcaagccagtggttctcaaatgttgttgccattagaatcacctgggagctttcaagagtcctgctgcccaggtctcacctccgatactcccatcagattctaggggtgggagccaggcaccagcactttccttgcattccccagctgatcccagtggtcaatgaagggtgagactcagagtgtaagcccaccctataggatacatccaccctcccacttctccctccctggatgaaacagatccctggctctctggtcacccttaggccattaaaaactcatgtggtcactggaagtcacctaacacagtatcgattcagcaacttaaaatgtttgggcccagagtgacatagccttggaacttgctccaaaactgagcttctccctctctccaggccacacctgccagaggtgggaaacctgtagttgaggtgggtgcctttattattcccatcatcaagaaagggagatttggaatgaatagccagggaggctcagccggcaaacagagggccaggagcggagccacatccactgatgcaggaccatccttccatgtcaccgcagtacccctgcaagagctgggggggccagggaccctctgtggatcagcttcatcctctgatccatccaggcggttgtgtttgtgtacatttttattttattatcattattcttttttattttgagacacggtcttgttctgttgcccaggatggagtgcagtggtgcgatcatggttcactgcagccttaatctcccaggctgaagcaatctgcccacctcaactgcctgagtctctggggctacaggcacatgccaccatggctggctagtcttttaaaaattatctttagtagaaatgaggtctcattatattgcccaggcaggtctagagctcctgggctcaagcgatcctcctgccttggcctcctgaagtgctgggattacaggcatgagccattgtacccagctgtgtacatttttaaacaaattcttgaaccaatctctattagtttcctaaggctgtgataaattactacaaactgggtggtttaaaacaacagaaattcattctgtcatggttctggaggctggaagtccacaatccaggtgtcagcagggccaaagtagtctctctgaaggtgctgggggtgggggtggaatctgttccaggccactctcttggcatcacagtgttacctgcagtccttggcattccttggcttgtggacacattgctgtagtctctgcctgcatcgtcatgtggcattctcccagtgtgtctctctgagtctcttctcatcttatgaggacaccagccatattggcttagggcccaccctaatgacattatcttaacttgattacatctgcagagactctgtttctaaataaggacatattcagaggacccaggattagaacttcattctacctatcgaggggacacaattcaaaccacaacaggttctgaagacccgtaaaggataagcatcttggccctcatattagcagctgttgatcttggggcagcagtgaacagatcgcttatttaaacctcagtttcattatctgtgaaatggggacaaaactgtgtcctcacggaactgttcatttagtgtcttagaaaatgtttcctgtgtgccaggccctccctacatggaatgctttaggttaagggatgtgcctcagagccttccaagtgatagataacaagatgggggtaaacacaggggctccaggagcccagagatcaggcaagccttcaggggtttttgacttgaactgagtttgagagatgcatggcggttatgcagacataggagtgtgggtgttttgggcagagggaactgtgtgcacaaaggcaagaaggcttgaaacagtatctcctgttgggagtgtgagttgctagtggccattggagcagaggggtcaggtggtgagggggtgggtgtataagtccagggagcccgaaaccagccaggtgacctcatggagtggagttggatggagtgggggctgtgatgccctggagagcttggccagcctggcctggatggggctttggagctctagccccttgctcatgccatgcagaaacacaggcctggggccgcaggtgcttctgtgtttaaaagaaagctgaaactttgattttctcatgcactctggttgttttaatgttaacaattaaattaacaattaaatgttagaaatttttaccagacctaccaaccatggtgtggactgtttctgttacttactgcttatgacttcagttacttaatggcttaaagcaatcatttattgtgctgacgattttgtgggaccagaattgaggaagggcttggctagacagtttgtttttgcccgagtggcatcagctggaacagcagagactggagtctaggcttccagcgtgtagtttcctctgaacttgtctggtgcctctaggcaacttggccactctcctcttgggatttcatcctgcaagggcttcttcaggtgacttgggcttcctcccagtatggaggtcccaaggttgttgctcttcttgcatggtgctggctcccccaagaaagagtgttccagcagttccaggtagaagctgcaggcttcgtaggacctgcctagaagtcccagaatgtcattaacactacattcttttagtcaagaaagtctccaggccagcccagatttaaagggaggggagtcggattccagctcttgatgtagtgtgtgtgtctaggagcaagggacagaatggatggtcattgtccttggggactggctactacttgaaccaaacaaaacaggtgtgtgggctggattcatcccggggctgccagtgtattatctctagactaaacaagggtgtgtagagcttggcaaaaccttaaaatactgccaagcccagtagaaaagtcacttattactaaggaggtaggccatggctttattaggctgaaccatgtgaaattgctgacatttgaccatttttgacctatcaaatgaccattttatttggttcagctacatattggggagatccaagtaggtttcctgtgcttgaggagctgggaattcccccacctcgctctttcgcctgtctcttggaatctggcccttgccaggtgggaagattcagtctcacctacatattaacatcatattaacactgggcctgtccttctgggagatactacatgtgtatctaatcacagctgagatgctggcatatcccctgctaattccccttctaaagagaaggtcccccaggaccttgagagactcacagttaatttgcattttaatcatttttcacagaggggaaaaaagacacaaaagacatctcttcctattggagaggtgattttgttatctcttgaaactgtcttagctatggggaagggcctcattctgacagatatgcaagaaactagcagaagttgtcggtccccagaggaacatatcgctgcccagaaaaatagaattctagggagtctggcagtctgcttcttagagaatattttcttcagccaatgagtgcttctttttcttcaagcaagaattatcattaaaatacaaattgtctgttatcttagggcttgtctggttgtacttcaggtttccattgcaaagatttaaatattttatccttctaattagacctgcttcaggagagggtataaggccacattttatgcagaggtgtaatgagcagttcaagaagtaaacattccagtgatttttgtagaccaaatttctagtgttttaagatttcagacatatgacttgaaacaatggaatctcacaaagctaagagaactgggacatctgcaggtggatggccagtctccaatgaaatgcttgagtgtttagggagcacttgctgtgtgctctgtcctgctcaggtcctgcaccccagctctttctacactgaggtgatggagacccatctgtgttcactccctcctcactgtgtcccctcaagacatccctgtaccttcccatcacagctaccattcaacagatgcctttgaggtagcagacaaaccctgtgctgagcaacacacacaatctcactgaatccttgcaatggccccttggaataggcacattcagatccattttataggtgaggaaactgaggcttagagggcacacagctggggatcaaacacaggtctctgcatcacgtcagcctattatttttaagaacttttttaaagagatgttttaagttcacagaaaaatcgagaggagggcatagagatttctcagatgcccctctgcccctgttcatgcacagcctcttccaccatcagcatccccaccggagctgtgcatttgccacaactgactaacctacgtcgacacatcagaatcctccaaagtcgctgagcccggtggctcatgcctgtaatcccagaactttgggaggccgaggcaggtggatcacctgatgtcaggagtttgagaccagcctgaccaacatgatgaaaccctgtctctactaaaaatacaaaaattagctgggtgtggtggtgggcgcctgtaatcccagctactcaggaggctgaggcaggagaatcgcttgaacctgggaggcagaggttgcattgagctgagatcgagccattgcactccagcctgggtgacagagtgaaactccatctcaaaaaacaaaaacaaaacactccaaagtccatagtttacattagggttctctcttggtgttgtacattctgtgggcttggacaaaagtataatgacgtggatccacgttatagacagtattttcactggcctaaaagtcctctgggctgcatgtatttgcctctccctccccttaactcctagcaatcactgatctttctactatcttcacagttttaccttttccagggtatcatagttggaattattcagtatgtagcttttcagattggctgctttcacttagtaatatgcacctaaggcttgatagctttttctattttattttttatttttatttattttttatatttttgagatggagtttcactctgttgccctggctggagtgcagtggcgtgatctcagctcattgcaatctctgcccccccgggttcaagtgattcacctgcctcagcctcccgaatagacgggattacaggtgcatgccaccatacccagctaatttttgtgtttttagtggagatggggttttaccatgttggccaggctggtctctaactcctgacctcaggtggtctgcctgcctcggcctcccaaagtgctgggattacaggtgtgagccaccacgcccagcctgctttttccattttagtgctgaataatattccattgtctggatgtaccacagcttgtttgtccattcacctattgaagaacttcttgtttgcttccaagtttttgcttttctttttgagatggagtctcgctctgtcatccaggcttgagtgtagtggtatgatctcagctcactgcaacctccacctcctgggttcaagcaattctcctgcctcggcatcccgagtagctgggatttcaggtgcccaccactgtatccagctaattttttgtatttatagtagagacagggttttgccatgttgggccaggtgtggtggctcatgcctctaatcccagcactttgggaggccaaggcaggcagatcacctgaagttttggcaattattaataaagctgctataaacatctgtgttcaggtttttctgtggacataaatttttaagagcctattttaaaatccaatctaacaatctctgctttttaaatggagtgttgaagcttttattttattttatttatttatttttttgagacagagtctcgctctgtcgcccaggctggagtgcagtggcttgatctcggctcactgcaagctctgcctcctgagttcacaccattctcctgcctcagctatatatatatatgtgtatatatatgcatatatatacgtatatatacgtatatacgtatatatatacacatatatacatacgtatatatatacatatatacgtatatatacatatatacgtatatatatacatatatacgtatatatatacatatatacgtatatatatacatatatacgtatatatatatatagagagagagagagagagagttctgtcttctctctcctcttcttttgggactaatacacatatattaggtcacctgaagttgtcttagagctcactgatagtctcttcattttttttttttttggtctttgtttctgtttgtgttttatttggatagttattattgatatgtcttcaagttaacaaggttttcttctgcaatatctaatctgctattaataatagccccacccaatgtacttttgatactagatattatagttttcatctctagaagctaatttggatcttttatataaaaacatatctcttccattctcttcttaacatgttcattgttacctgtagctttttggacatatggaatacagttataacaactgttttaatgtcctcacttattaattctaaatatgtcaattctggattggttttgattgattgccttttctcctcatatggttcatattttcctgctgctttacatgcctgataattcttggttggatgccaaacattgtgaatttaactgtggtgtatgctagatatttttgtattcccataaatattcttgtgctttgttctgggatgcagttcagatgcttgagaacagtttgatttttgcaagtactgtttttaagatttgttaggcaggatcaagccaaatttaatctaagagtaattattccccatcacaaaggcaatgctgttctgagtattctacctgctcagtgtctcataaatgatgagattttcaagatgggtgatggaaacaggcactatttctggccctatatgggttccaggcactattttctataattttttgggtgattctttccctgcctcaggcagtttctgtacaaacatgcattcatctgtcctttgttgaatgtttgagtggtccctctctcaaaccccagggttctctctgtgggcggctgtcttctctccatactctgccatgtggtctccagctgcctcactctcctcagactctcacttccattcttcaactcagagagtccattgagccctgcctgagtttactgctccatggcctggaaactttccataggcagtaaaccggagcacctgtatggctcatcttgccaatttcccatctctcgagggtcactgtccttcattgtctgatgtccggtgtcttgaaaatcattttcatgtattttatctggtttttcagttgtttcagttgggagggtaaatctattccctattactccattttggctggatgtggaattttcataaggctgtgcttttaacagctatatttccaccgttcctccttttctcccgttgtgggaaaaggaatgttgacacttgaatctaaatctagaccattacccctacctcccagctatgggcccctgatccagccagcatttctctttctccctgtctcccaaatgccacaaaatgtgagtaacatacatacatactctacaggtcaagtgagcctggggaataacaagtgaggatgccaaatcatgcatggaccagcctaactcctttccagtctgccgttgccacttggagttcttccaggtatcctgtgacaggatgttccatgagacattgagggagccagtctttgattcaggtgtggggtctgcagaccaggacccagagttgggcagttcagtgagcagagatgggttctttaggcctccatcccaaatccctgggtcctaggaagccttgttccccagaaggatgaaagtgaggggaaatgccgggagcaggttgctccagcctgaggcccacgcagtttgccagccttccatttagccaagagctggaacactgctgatttcttccagccctcgtgaggacccctcatccatctcctcagcatgaagctctggaagctgattagaaatatattaagacttggtttccagcagctttgagggacacctgaggggggctgactaatgtgctctcccaggcaccctgaaaccgtctctctgcattgagtcttagcagcccttcctgcatctcctgccttctctctgacctcctgccaatccttcttctcttcctatggaggttccacccgggtcctgctgcgtatcccaataatcaaatcaattaggcagggccagccgtgcaggcaggctgtgttggggaatgtggaaagccagaaagaagtgattgccagccttcatcgtctttgtcatccttgccaacagcatgagagcacacattgcatacagaccatcattcctaggcacgaagacctgtgaggcaggagccccgccctctggtggaagaagaggatagctgtcgtaggtgaatcttgagcacctgctaagagttctgtgctgcgtgggcagcctatgaaggcaacacattcagcatgcccattttagagaagaggataccgaggctcagagagctttggggccttgcccaaagtcatccaggtgagaagaggctaagctggggtcaaggctagatctgagtcacagctgatggattgtagagtgttggggtgagatggaggcagatgtgagccccagagagtgtggttctatgtcacaactccttccagcctggccgtctctgcagcctgtctgggcagagtggattgtggctgaagccaggtgtcccacgactcagacaggctggtgccagaggtgggggtggggaccccacaggaggctgaaagaattgagaggggcgttggaggacaggaagcttgctccccccgggagaggctatacctctcctctgcccctgcagctccaagcagctcaccatcagggcatccctcccttccgaggttcccttgagggccaaggttctcatctcatttatgtcaggattgctgctgcccagcccagggctagaaccagtaaatatttcataaaccaatcaaggaagagcagggaattaataaaggcacaagaaagaaactggacagaaaattatggcttgcatcagcttgcggggcacctcctctttgagtctggattatgactttccccaaggccagtgatccggacagcaccaagtcccccacccttgccccacgtcctcaaactccccagtccccagcgcccctctcttgtccccctgcaaactgtctgctgcatgctgggcccagcagcacaggcattctgcgcagtaccctcttcttcctctgaacgattccatggtgtgaacctgggatgactcagttgactcaggaggagagtggaggccagacagggtaagacgccggctcaaggtctttcaatggggcttgtatttggagagggctgacccctttaaacctctggacttctctgtcaaaatggtgactcagaggtaaggtgaccaaccaccccggtttctgcagggctgaggggctttcaagacaggagacttccacttccagtgctgaaaccaggacagccccaggccaactgggatggctggtcaccctacccagaggccatttaaaagcccagaggctttttggatctcactgtatttgactaacattcttgctttttaaaaatgagtggggatggttgaaaccatgtccagaatccacacctttccccggcccatttaattctcaagtgttaacaggcactgaggatgagccagacaccgttctaggcactggggacgctggggaacaagcactaaattccctgctctcgctaagggcaccttgtcctgacagctgctcacctcttatgaaaggtgaccaaggagcgagggcaccacacagtccctgctgtctgctcacttctgtgtcccggcagccatgcagagaggtgcccagtacatgttgactttgatgaatccatcaggaaggcagcagaagataagcagagcctgggcagacccctggcccccagaatgggactctccctgggctggccagactcagcaaggagcaggcaggccccctcctcttctgtggtcctagaaatcccaggctgagccccaacagcagctggtggtcttgtaggaggagcagagccccacccccatgatggcctttgcctgttcagtctccaatggccacctgtcacccagaagcctcccagtgttacagaacactgttagccaggtcacacggctcaccctgtcagtctccagcagcccactgtgggaggaggtaccaaaaaaaggagggatgtggtcccacccacagtcatgaggccttggggagggagcactccagggagtcaagccatagcccccagcagaacactaaagcgtctgtcgcatctctctctttacccatctgtctgcctctcctctgcataggagaccctcagggctaatgcagtaagctgtgcctctctttacagctctctagggcctggctggtggaaggccttaataaatgcccgcagtgagcataatgacccctcagttggggagggtggtggaagttctgactcgtctgtttgcgctattctgggatgctgaccaaaccgcccatgtagaagcacagactgtaatgtgccagaatccctccccatcatcccttatgcagggtgagtcacccgttgtgtctgtatctttagcaacaggaggctcaccacctcaccaaacagagacttccatgggagtcaggtctccctgggctacagcatggccctgccactgcgctgccggggaaatcacgtcatggtccccagccacggcattctcatttgtgcagtgcactgatggtagttatgatacgttgccacaagccttgggattttgccgcttaaatatggtaatgtggcacctgagatggggaggcaggaggcttgagttcccggcctgcctccaccactcatgatttggggctgtttgacttggaacaagatgcttaatttcttggagcctcagtttccctttctgttaaatgggaacagtagtaatagctcatagtatgggtgggagaatcaaatgagatggtgaatgagaaagaacaaactgtgcagggcagcatggacaccaggaattattatgtttgaaccaaaactgtatatccccctccgcatcatccctttttttgggctaaatgtagccattttcctcaactgttttcccaaatgcacattctctctaaaaatcttcactaggtcaggctctggtctgttagtgttcttatagaacagttttttcagaacaggacataataattcaggaaaatctattacctccttggatctagccctaatgcattcactaatgtggccagtgagggccaaatcttgccttgtctaatgcaaaacctttgactcattctgagaggagatctctctttcctaaacactgctgttcagccacgtctctcctccaggatttttacaactgatttttttgaagcttagcacagatatgtcaagaactgtgaggggtttgcaattttactttgccttcaagttagtcttccaaaatttcaaagatgcagacagaagacatgagactcccggagtcaaagggcattattactcacaccgcagcaagcgacttgagcttcatgctcacatcagtgctccctgctctgcaggtcccatggggcaatgtggagcagcccgggtgggttccgcgcatgccatgggtttgtgtgacagctgaggaacccaagcttagaaaatcccactcttttcagggagactgctgacaaacctgcccagcctttgcctcagagtgagagatataattatcctggtcaggaaacagatgtgccctctgccccagaggggacactgtcttttttcaaggctgtttactttacccacatcttgaaaagatagtccagaacagagactatcaaatcctctattcaaaaggcacacagaacaggattctatggagaattgccttccaactatgcatttatacgtatccttcacaaatgccgctgcgtacatctgggcctgcatctcagcttggccactgctgagctgtatcaccttgggcaaactcctgaacctctctgatcctccgttttccgcagcctgtaagaggaggtataattcctatcttccagaagttctgtaagggactctctgaagtagtgttcatgaagcctcctcaccgtgcctggtacagaatagaccatggagaggaggcagcagggccaagatcactgtgatttagagcccatccttctgaccacttaaatctctttccttcactatccctccccgacttagtcctctggctcctgtttcttccctgccaagtggggcagaatcacctgggtagctggtgttgcaaggcttggagcagagatctcagagcccgggtcgcacctaggctctgggactgggtggtactttctaagcttagcctcagtgtcctttgttacaaggaacccaccccctgggatttaagaaataattaaaggagataaaaaacatgaaatgtttggaatgttcctgcaagggacaggtgctcagtaaagactttatgatgcaatttggatagcttgagcctctcagaatgcggtgtaggccattctagctgctccccagagggaacttattagaaaaagcaagacaatttgcaagcctcttgcagctcactcagcatgctggtggcatgcagcagcaattggctgtacattcagcattcacgtgacatggccctctgtgagcttctggcttggggaatacagaactgcccagggcggcctgcaagggggtcagggtggtcagctgggcctttttggccttgacaatactgctctcacattgtgcgaccttagggagaggagagtggtgaggaacctcctccttctcgctgggctccgctgaggaactcagcactgcatagtggtcaagggtttcagaggaaatcagactgacttaggtttgaatcccgagtttgaaaccagctgggtgacttgagcacatcacccatcttcctgagctcagtttcctctactgtaaagtggggataatgacctctcctggctcgtggaggtgtaaggattaggtaaggccatgtgtgtgcagaggctggccaggaaatggtgcctatgatgacgttgcactattttctgttttttttggtctgcaaaatgcaggttgagtgggtagaccctaagatctcttatttcatggggagatggaaaaactcctggagttgcagtcagaaaaccccggtccaaattctttatagcctcacacaatttatctgcacctcacctgtagatggtgccagctccccacgcctccttctgtgatgtatggcaaaaacactggtcaccatacctgacagaggactttggtaggtgctcaaggtccctctcaagctccagggttgtcaatgaccagggccgctggcctcaaagtatgctccatctaatcagggctatagccagtatgaaggtaactcaagcatcagacacttaatggggctcacaggcacacctacagggttttgctgtggtttgaatgtttgtctcctgcaaaactcatgttgaaacttaatccccaatgcaatggtattatcccagtcaggaaacaaatgggcttttaggaagtgattagaccgtgagggcttaaccccctcatgaatggattaatgccatctaaaaggccttgaggcggtgaatgcactccttctgtcccttgcactttgtgaggacacagccttcctcactccagagggtgcagcagcaaggcacaaaagcagagagcagagaagccttcagcagacaccagagctgcctgcaccttgatcttggacttcctaacctccagaactaggagaaataaaattctattgtgtataaattgcctagtctgtgggattttgttatagcagcacaaacaagctaaacgaagaccggttccaatggctggagctgcctgtcactctgttctgatgctgaggattagacctcagggcatctactggaatggttcaggctgaaggagctcattgaaccccagtggcacacagggtgaaccggcccagcagcagactcctttttgccaaacaatgcaggagtgatgtcttctgcaaaagtggaatctgtttggcctcctgctgatgaatgatgtctattggtccttggaagtagagtccattttttatacttttggtcaggaaaatcacgtggtgctagtagacatcctgggagagaatcctgcaggcctcctgcattgtacctggaaggaagctcaactccacccctggatcctttgtggagaaccatgtggaggcactgaaattccttcacgtctcttggttcctgtcgcggaggttggagaagttaaccttaggtgccattggtcccttgagtcaccataaccataactgaccatactgaccatgctaacgcctgccttgctgtgtgctgggctctccgttgaacgtgttacacagagcagcacagctaagcctcaccaccatgctctgaagtcgagattacaattaagcccaattttcaggtgaagcaactgaggctcagatttgaaccagccacctggctcccacgtgctgtgtctcatggctcacttcctcagctcagggtctccactctcctccctgcccgcacttcgtgaggcacatcctcctcactcggtcactgtacacctctgtctgtgtccaacttactcacaaacacaacttgtggctcctggaagtaactgccttctgtgacctgatgctattttattccattggaataaagatccttaatgatgccatttctacctcccctcttccctaactcccacctcaactcacctcccccttcttttaagaatcttgtgaacattggcttatttatacttatgcaccatctcaggcctcccggggaaggttttaatcatctaccttcttgctggagacatcttgaaagactccaatccttcacccatgctgagaacatctcaagcaaagcaagaggcatgagaacagtttttaattgaagttaacattgtggcttttcccacacagccagacactcaggcatgttgggaagattaaaagtgatgttggaaaatgcatccacgagtctgtgccctcaagcagaaagcagcagccacctgggctcatggatcagacaggatgcatctcaaacagagaatgggaaggatccatagatttccctgcctggcccagctctcccaggtgcctcctacagcattgcagcagtagggctgccactggcagggctgggaacagctcgggggctatctcctgtgcagggtagccacaggttgcccaaggggctttgattccccagtcttggctctgccagagcctggttgcatatcccgagaaagtcatgactgagcctgtttgcatatttgaagaggggctcaagattaccttccccaggctgggcgcagtggctcatgcctataatcccagcactttaggaggctgaggcgggcagattgcttgagctcaggagttcaagaccagcctgtgcaacatagtgagactctgtctctacaaaaactacaaaaaagttagccaagtgtggtgttaaaaaattagcctagccaggtgcacatctgtagtcccagctactcaggaggctgaggtggaaggattgcttgagcccaggaggtcgaagctgcagggagccatgattgcagcactgccctccagcctaggcgacagaatgagacactgtcaaaaaaacaaaacaaaatgaaaaacctgccccatgggtttattttgaacactggatgtggtaatttgtgcaaacagctttgcaaatataacagatagtaatgacacagcttgacatgtattgagcactcatgaagggccaggcactgctctcagcacttctcatcattcccattctacagatgaggaaactgaagccccagggttatgtcaccaagccacacagggagcaagtggcagagggggatttgcaggtcatgtttgggcatccttgctgtcagccactgtgctgtgctcacttgtcacatggcagcatagctcataggatattctttaacctggcagtagtgtctgctgggggggccctagctgggttgggtatttcttgacccagtaacatccatccaaactcccatgccactgcttcagcccttggtcccgcctttcctcctccctggacgactgcaggtgcttctcacctggggggtgtctccagttgcttcctgatctgtttcctttcttcactcttgccagagggagctttctcctgctgagggtcttctgtggcttcctccatccatgggatacagtgccaggtccttgggccaactgttgttcccatgagcagaccccatctctaggcctgggcccgaaatgcatcttcttggtgcccacaccagtcaggctgagacacatgcagctccccatagtggtgccccaaattttcagtgccttgtccctgggatgcccccctcccctccttcagtgctggattcagaatccccttcccacaaagccaggtgcctggatcccacatgctaagacactgtcctttcttctgagtggccagtgcccttttgtagcattcctgaggacttctccctccctatcggctagattgtcatttgtggagctgatcggctggttcttgtgtggctccccagcacaggacacagggctggtatgaagttgattctgcacagaaaatgaaggaggtgggattggtgtcacaggcccaggtctctgctggcccccacactggctgtgtgatctttgcaaaggtgaccccctacagctaccatctctgcaacagtaaaaatggaatgacagctgttctattggcacggtgaccactgaccagccaagtgagctgcgatgtgctttatgatgtgtagagttccagtgccgtgcatgttcattgcttgagtggctaaacagaatattgagtttattcagcagattttttatcctctgcaccctcattctcgtgctaccatctggggactcagggctcagctccctgacagagtagtgtccttccccactctgtctttctcctttgcctcacccattcacttgatttcctcctcagccacccccaattcccatgctgcatgcctgaaagaggcaggaacttcacctctatgctttggccagaggcctcttctctcccacccgtgcccagtgccagggactcagcccagcatcagcaaatccagcaaacacatctgtctaaagaggaataaatcccacatctcccgtgccaaacatccaaggagctgagatgggaagggtctgggtaaagggttccctgagccctgagacacatccctgcccatttccatagcccattgtgtatttgccatagacctttgaataggaaggaaaacagtaagctcataattctcaagtttgaaaaagtccttcccagaacatgcaccatctttaaatagtaaaaacaaagacaatgccacgaccatcacctactactaatgctactaaaactaaacacaatggcagcttattaaattaccatttccctggtgctgggctctgtgcctaaaaccatgcactgggcctcattctcagggcttttcttctgtcagctcaagaagtcctcacagcacctcagggagggaaatattttcattacccacatttagagataagaacgataaggcccagagagggtgagggattagttcacagtcacacagctccttagtagccaagtcagacatggggtgcagatggcccagctctttgttcctgcaccttctccctgttggagtagctggggttggtgttatctactgccattgggcatgtattcgcaccccttattttagttcataggttcatttaaggagctaactgtgtgtgtgacaaacagcaaacgtggctgcctggagagcccaccaccagagctagagctgtgtgtgatgaacgtctgcagtggcagatatgattcactggggttctgattctctgtgggtttaacttattgtattttcttttaagtagcactaatttgccatcatgtgcctttgggtgggcaatatttaaagaaataaacatctcaggacaggtgcagtggctcacacctgtaatctcagcactttgggaggctgaggcagaaggatggcttgaggccaggagctggagaccagacagggcgggtctctacaaaaaataaaaagttagctgggtgtggtggtgcatgcctgtagcttcagctacttgagaggctgaggcaggaggattgcttgagcccaagagtttgaggctacagtgagccaagatcacacaactgcattcagcctgggtggcagagtaagaccctctctctaaaaataaataaatagataaataaataaataaacaaacatctcaacataattccacagctttcttacaaatgctcaacagaacaattattctaatattttgtcttctatctcagtcaccacattcccccttaacgaggagttagtcaaactttctgaggataaaccctctatccagctggtccggtcctttggctcatgttgaagtcaaaagcccttgcaggcagcttttcttgtctgctcatggcttttctccagcaagtcgctccatggatcgagtccctgccatgtgcatatgtcttctctgaaccttccacagtctgcccactagggtgttgaaccacaggtcaggtaaagaaaatgggcttggagtgaaggactggatgtgtggctatgctaccagagagagagcctgactgcaccctggcctgaacccctagtcctctttcaccctcaaccatgagatgagcatcaccagctccaaatgctccccattaatcaagaaagaaaacaaaaaggaccaatggatcttcgtgttttcctttcgtcaatctactttctctctcccctgccttttgcaaaagctgacatggagattgcagccctccacatgtgtctttatggtaataatttgaaacaccagcactgcctgtttcaattggaaaggaggcatttcctgcctcttaggaaaaagtcctcctgcccagctccctgctcacggctgctaaggttcacatcctcgcaattccaccactctgagctgcatccgtgtcagaaccgctagggagtggtccagatccctttgccaaacatttcagcaactggaacccaggtttctcaacagaggattaaagcgctgtcttcactcctgggctgccaggtacattcttccttggccttcggagtgcccttacatactctcaggatgaatccagtcttgtttctgagatgattttctttccaacaaacaggttacttatggagcataatatagacttgattttgcccaaacaagccactgagcatttattgagtgcctgctatgtgcaaaacactgaggatcaaagacacaccacagaccctctctgcccagagtcacaaaaagagtggatgtcagtacttttatcacagaaaaaaattttttcatctgatgcttttaaagagtttggaaggtggatgaggcagggatcgtcatatctgtttgatagctgggtaagcagaggccagggagctgtgaagcagccgttgacttgcagctggggcgggtctcaggcctccttgctcttgtccaagctgccatcccctcaggaacagagggtgaataggatggaggttccgtataagaactgacctcttgaaaagtactgtccacccaaggaacaggactgtggtatccttttgtttgtttgtttgttttttgagacagagtctcgctctgtcacccaggctggagtgtagtggtacaatcttggctcactgtaacgtctgtctcctggtttcaagtgattctcctgcctcagcctccccagtagttgagactacaggcaaacgccaccacgtcgggctaatttttgtatttttagtagagacggggtttcaccatgttggccaggctggtctcaaactcctgacctcaggtgatccacctgcctcagcctcccaaaatgctgggattgcaggggtgagccaccacacccagccatgtggcatccttttgaggaacaacaaaagttacgtccctacattggcttaggcaaggatttggtgaccaagaacccaaaagcaaatgcaataaaaacaaagataaatagctgggacctaattattctaaagagcttttgcacggcaaaaggaacagtcagcagagtaaacagacaacccacagagtgggagaaaatcttcactatctatacatctgacaaaggactaatatccagaatctacaacaaaatcaaacaaatcagtaataaaaaaaataaacaatcccatcaaaaagtgagctaaggacatgaatagacaattttcaaaagaagatatgcaaatggccaacaaacatatgaaaaaatgctcaacatcactaatcatcagggaaatgcaaatcgaaaccacaatgcgataccaccttattcctgcaagaatggccataatcaaaaaacagtagatgttggcagggatgtggtgagcaggaaacacttctacacagctggtgggaatgtaaactagtacagccactatggaaaacagtgtggagattccttaaagaaataaaagtagaactaccatttgatccagcaatcccagtactgtgtatctacccagaggaaaagaagtcattatgtgaaaaagatatttgcacaggcatgtttatagcagcacaatccacaactgcaaaatcgtggaactgacccaaatgcccatcaatcatcgagtggataaagaaactagggtgcatatatacacacacacacacacacacacacacacacatatacatatatgtatatatatacacatatatacacatatatatgtgtatatatatgtgtatatgtatgtatatatatatatgatggactactaggcagccataaaaaggaatgaattaatagcatttgcagtgacctggatgagattggagactcttattctaagtgaagtgactcaggaatggaaacccaaacatcatatgttctcactggtatgtgggagctaagctgtggggatgcaaaggcacaagaatgatacaatggactttgagaacttgggggaagagtggaagagggggcataaaagactacaaatacggtgcagtgtctactgctcgggtgatgagtgcaccaaaatctcacaaatcaccactaaagaacttactcatgcaaccacaaaccacctgtaccccaataactcatggaaaaataaaattaaaaaaattaaaaaataaaaaagtcacgtcctcatcttaatttgctctcctggcattttgcattttccatgctgggattccgctctggccagctctgttgaacaggctttgctggttggcagggattgtgcacacacatggtgccacctcccttagcttctctggccctgttttcttcctaacccagtgtgctgtcttcctcccatacataggtagggggttttgacgtgacttcctggacatcatgtgtagcggtcgggggagttttctctggcttctgacccagctgggtgtactgaaataactgtgaggctgcagggttctgagccggattgtgttggcacaggatggccacctctgtgccttcctcttctgctcatacaggtgcccctggggaggagggtgcagtgtgttcccctgagagctacattggttggaggagactatagcattttagaacgtcctcctggagattccgatgtgcatctccagtggagaatctggccttttgttgctgttgtttcatgccatgattactactgaagacaattttgccatatagaggagaggatgtttaaaaataaaccaaaaggatccacttagggaggtaaacatcctgggcttgccgttgccccggccgccgcttcactccagtatgcgtgtgctcgctgatggagaatgatgctcagtttcacttttattccttttgtcctctcctcttagccttcatcaccccccaccactttccccttctctctctcttcctccaaaatagggattacatagtttttttcttggtacctctggcttctagcctgaccccctccacccccagcatgtagtaggtgctcagtaaaaggtctgttcagccaatgaacgagataacaattgaacaaacacattccccacccatcctcctaaggccctgagactttattctgctcagtggcaaggaatttaatctgattaggaggctgctgacccacacaggggacgcccatttggttccaatgacactgctgaatcacttcaaagatgctatcgagttaattggggtagaataaatactaatttatggcaacctttgccagctcttccccaagggaaaatttttaaactccccatcctcttgctttgcttgaccgctgagatccagtgaaagtggcctgaacttcccatagctgagccaacagaggcacagcctcctcccccttatccccacctcaggaagccacagccacgtggaggagctcctcaggtacagccagggaggtggggcatctcaaacaggccttggctgtttcttcttaaggttcttagccagcctcctctgaatgcaagctgtggctctggggcttgtcccagtcccctgaattctcaccatggaccatgggatgcgcgtggaggacaaggtccccagggccctggaccacaccatctgagcctttctgtccccgcagggcaagtgcttcttccattattgctaatctaagatgctgtgctctgatgagacagcgttttctccccctgcgttgtgctgagttactatggcaacactttcagaagcggtgaatttgctttttcctcttaattctgaaatgctctcaggctttccaaaaatatccttatttccctgggtccaactgtgggttgaggcatgtcggacacacagaaaatagagccagctcctccaccatgtatatattacatcaagtagctcagtgcacagcaattgtttgggtaaacttttttttttaataaaaaatatttttagcatctgctctatgtcagtagatgtgctaggcaccgggattcaaagagaagttagactcaacccgtatcctacaagtgctcacagtccctaagaaaaatagacaagtacacagttaactataatgtaatgtgagtacacatctaactataagataatgtaacataacataatatattgtaatgtaatataatagaatgtactataatacatgtaatgtagtaaatataatgtaatgtaataaatattttgtcagttctaggaataaattagtgtaagaccccaatagagaaagctgttaattcaacctggagtgaggagggttaggagttggtagatctagagtttgatttctgatcaattacgtatgggctgtgccagctcagggaaatgaacatccctctctgagctccaaacctctatctcatgctgagctgttgtgaaaatgaggggacaccatgaagttacagcagccagtctcagagcagctgttactcaaaagatactgctcttccttgcccaggtgctggggtgcccagaaggggctcaggagaggaagtgagcatagatagagggacctgcaggcagcagcgtgccagcacttctgtcaaaggcagtcgcgccagcagcaaggtggccgcgtgagcacacctggcacatcagttcacagggagataggaaagccagtgtggccactgcaggggactggacctgaacccattgccatccttgggctctgggtgggaccccttttgaaagcttccactgaaccagaaagatagcacagtggtaaactgcttacaagggaggcactgcaacaaacatgaacattgctctaaaaattagtgtgcactctgggaggccaaggggagcagatcacctcaggtcgggagtttgagaccagcctgaccaacatggagaaaccccatctctaccaaaaatacaaaattagctgggcgtggtggtgggcacctataatcccagctactcgggaggctgaggcaggagaatcgcttgaacccaggaggcagaggttgctgtgagcggagatcaggccattgcactccagtctgggcagcaagagtgaaactccgcctaaaaaaaaaaaaaaaattagcatgcactcagtgtaggtcccagtgtcattgtgcctggtcacacttggagtgctgtaggcgtgccctctaccttccaccagcttaggtgctctttgagggaagaaagcagccctctttgtcctgctcaatgttagcatatgcaggtggccacttataggggttccagagagagttatgtcttctttactatgtgtgcctgtgtcctcgcctgtcaaacaagggtgacgatagtacccacctcatagggttgcgataataaaacccaatcatgcctgtaacgtgctcagcccatatctggcatatagcgggctctcaataaatattagctttcatttttatttcatccacctcattgtaaattgaagactctccagcatggaaacattagtcaaggagagtggcaagtactgatacccagtagcaaatctttcccttaactgcaccctgcgtgggcgaacagcacagaaaggctcggtagctccctgtgtgttggaaagcttaatgaaagagcagattatgttttttcagcaaaacggccagatttggaggccagttctctgcaggatgtcacctcaacgtgttgcagggctgggcaagttaatgagaaagcctttggggtttggggattggagaaggcctggatgccattcccaggtgtgtgatgtgagtgatcttaggcggggtgctccgtgcccgtccagcgggcactcactgcagattcgtgggcgctgattccagccttcagcctccctgtctgtagaaagaggcagaccccacccactgataccctctacagggagtagaaaaggatttctcacttccagatgagaccaaagctgggactctttggagctctctatttctgcctccctcaggatgagcacacggaccatgtagggagcagcagccgcttactacccctgggaggaaagcttggccacattcatcagcaaaagccgatgcacctggcttctgtgcaaagttccgcccattagctcttgtcacctttagcatgtgctgtgctccaggggctgtgctgagcaccagaggaccgtgatggttcatttaaagtgtcgacttggctgcaccctgggatgcccagattgggtgtgtccatgacagtgtttctggatgaggttagcatttcaatctatggacccagtaaagcagatgatcctctccaatgtgagtggcatcaaccagtccactgagggagaaggaaaaaggaattctccacttttatctcctgcctgcctgcttcagctgagacattggtcttctgctctcggattgggttttaccccctcagctcctctggttctcaggcctttggacttaggactgaattatgccaccagcttccctgagtctccagcttgccggtgacagatggtggggtttctcagcctccataattgtgtaagccacttcctcataataaatctcttcatatatatatgtatatatatatatatgtatatatgttattggttctgtttatgttcacatatatatgttattggttctgtttatgttcatatatatatatatatatatatatatatatatatatatatatatatatatgttattggttctgtttctctggagaacccggactaacacagatttggtagagactattgatttctataatcctggaatattgcaaagtataccgtgatactcaggcaatttgaatttagtttctggttctttggaaatatttaaactatcaaagcctcagttataatacctgtgtggtgggaagacaccacctccacctccctgtgaggcacaccatgattagccagggcaggcatgggatgtgcatgaagctggacaactggcagcccagtttggagctggcgcagtcagcctgggcaggcaggaggcttttgaaggcttcagcctcctgcactggcttcaaaggcccaggactcagaggctgacatctgaccagggacctccatgagttacttatgtaatggagttgagggccttgatgatgtggaaatgcatgccacaaaatcctgcttttttgttaagttttaaaggacctcaacatgtattattttggagaggatggctttctactttgagatcccttcttcccagcaaacaccaaccaacctttatttttacagcctggaagtttattttgatgctcttggcacagacatctccctaaggagaagtcttcaaacctgtgctcattagcatttcttccagggccttccaagaccccgtggaggaaattcacagagcatgctgttgtcctgcttccacttaatattccacatcggagagccctgccccaggaagaggggccgacttttgtactaagccaggtagatttactgaaatgcatccccagacctcacctccacttgtagccaaggctaaaccaagagcctatgaagtaggagccttgtggacaaatgagggttttccgctgtggagggcactcaggttgtgccccttggaattgtccctttttcttggtaattaaatctaggtgcctagagtcctacgttctttacctcgttgtttactttttaaataattgattgcccacctcagtgtctcatgagccaggtagccatccttcccttggatcactggagctgacctcagcccagccttccctttctggagacggttacctatcaccgcctcattcttctccttctgcaccgtctaaagttctctccttgaggaagcccatggcagataaaactggagccaggtttgtagaaatgcaagtccttagggaggaggagacacttgaagcatgtcccaggaaacccagattctgatttgaactggattgcaaaggttcatttgccagggtagatgaagtctctctctctctctcacacacacacacacacacacacacacacacacacactgcactgaccccttctactccttgctagctgagggactaaccttaggcaaatcgcttaaccctttctagaggcagtttctgcatccccttttgttaaaggcacggatagaaattaccccaccagagtcattggcagttctgaagattccaatggaaggtgtgcaggggagtagctgcatgccctgtgtcctcatggggtgcacctgcatcaccttagtttctccatccctagggtagtagggtctctgaaaggcagctaaaccactgtgagttaatgactgccacactgtaaaggtcatcgatcattgtatgcagtttgcagagaccgctgagctcactctgagcctttggtgatgtgctgagaaggggaagcaacatccaatgaggtttgtattagtccattatcatgatgctaataaggacatacctgagactgggtaatttataaaggaaagagatttaattgacttacagttccacatggctggggaggcctcaggaaacttacaatcatggcgaaaggggaagcaaacacgtttttcttcacatgatggcaggaaggagacgtgctgagcaaaagaggggaaagctcctttataaagccatgagattgtgtgagaactcactcactatcacgagaacagcagcatgggggtaactgcccccgtgatccaattaccccccaccaggtccctcccacaacacatggggatttggggagctacaattcaagatgagatttgggtggggacacagccaaaccatttcactcttcctctgttgcccatgtctcccttcaagccttcatcaccaggagtctttctcctatagtgaaatgcaagcaagccagtctcttctccactttccctggatttggtggcataaactcaagtgttctgattgccatcattgctactactgtcaccccaattaagccgtgaacacacactgccccctggggatccccagtctttggccagcttgccacagtcccagccctctctcctgaaggggttcagatggcagcctgtggacctagcctgttgccaccctgagggatggtgccactcaacctcgggaagctgggcccccttctgtggtgagtgaaagccccagatgtctcagcagaagaccagccccagggggagtgtagacagctgcagggaggtggggcacacagggtgccctgccagggctggtggacatcgccttgtgcctgtccagccctgggccttcgtcacaaaggacttttgctgaaatcaatcagcttgagcttcagcacagttctggggcatgcctgggagagccatgtgaatgtggcctcacagagaggtgaagggagacctggtgtgaagggagaagctctttttggagttgcctcttactcagactccacaatggtcatgcagggctcaagagatcctccaagtcggaatggccatcagggttaaggtgggggatatgaatggaaaggcctgggactcagggagccgtgcccacgctgttggagaatccttccgagcacttcctcaggagagttgtcgcatgttctgcaggcctgtcgaaacaccacagtgatctctgctatgggctgaggtccactgagtctcgatttgccaagcacctttgtcatatatgcagtaaaatcttggcgctgtagaaagagcttgggacgtggaggcagatgtggtttggggtccagcctgaccctgggtgcttgggcctcagctgagtctgtgcagtgggaaggccaccaccacctcccaggggccctgaggactgcatggaatggtgaacgccgggcttgccacagtgcctggctcagagcaaatgctgcagtctccttcccaggtgtgcttttgatttacttgctaatatgcataccagaaaattgttttggtggaggggatgatacggttctctaacttgtaacaaatgcacagaaccctgtgaccatgaccacaataaaaatttagaactttccatcactccaaaatatctcctcttgctgcctcttgcggtcaaccacccactacctgacacatccctgtctctgctgttgtccaccccattgttttttgcatcatccagaataccatctaaatggccttttccacatagcttcattcagtgtaacctaatgcatttgagattcacccgtgtcattgcggacatcaataacctgttcatttttatcgccaagtgggattatattgggtgaatgtagacagtttgcccatttaccagttgaaagtcattcgcgttgtttccagtgtagggcagctatgaataaagctattgtaaacatttgcacacaggtttttggtgaacaccagtttttattcctcttgggtaaatacgtaggagtgggatttctgggtcatatgataaacatatgtttaactttgtaagaactggctaaactgctttctttaaatggctgcataattgcttcccacagcaaggtacaagagttctggttgctccaatttctcatcagaaattaggaacatcaggttttttttttaagtttagccattgtgatagatgtgtagtgttatctcatagtagttttaatttacatttccctaattaatgatgatgaacaccttttcaagtgtttatttgccctctgtatatatatctcttgttcagtgacatatctcctatttagctgttcagatcttttacctatttttaaaactgggttgttttccagcctcattaaaaagtgggcaaaggacatgaacagacacttctcaaaagaagacattcatgtggccaagaaacctatgaaaaaaagttcaacctcactgatcattagagaatgcaaatcaaaaccacagtgagataccatctcacgccagtcagaatggtgattattaaaaagtcaagaaacaacagatgctggaaagtttgtaaagaaaaagaatgcttttatactgttggtgggagtgtaaattagctcaaccgttttggaagactgtgtggcagttcctcaaagatctagaagcagaaataccatttgacccagcaatcccattattggggctatacccaaaggaatatataataaattattctattaaaaagatacatgcatgtgtatgttcattgcagcactattcacaagagcaaagacatgcaatcaacccaaatgcccatcgatgatagactggataaaaaaatgtggtacatatatgccatggaatactacacagccataaaaaggaatgagatcatgtcctttgcagggacatggatggagctggaagctgttatcctcagcaaactaacacagaaacagaaaaccaagcactgaatgttatcacttacaagtgggagctgaactatgaaaacacgtggacacatgggggacactggggcctgttgggaagggtgggaagagggagagcatcagaaagaatagctaatggaggccgggcttaatacctaggtgatgggttgatctgtgcagcacaccacatggcacttgttaacctacgtaacaacaaacctgcaccttctgcacatggaccccagaacttgaaatagaagttgaaggaaaaaacaaagtgggttgttttcttattgttgagttttcagtgttctttatatattctacttataagttctttgtcagatagatgatttgtaaatagtttctttcagcctgtggcttgtcttttcattctcttaatggtgtttttcatggagaaaatgtttttaattttaataaaatccagtttgcagtgttttcttgtatggattatgcttttgatgttggatctaataactctgcctaccataagattacagacatttttctcttaacatatttttctaaacgtgttatagttttatgatttcatttaggtctaagatccattttgagttttttgtataaggcatgagttttttttttttttgctgcagctgttttgtaatttttgtgtaagagattgggttccaagttcacatattctgtctctctatatattgttgcatattgacgtccacttgttccagcatcatttgttgaaaagactatcctttttccattgaattgcctttgcaattttttcaaaaattaattggccatattatgtgcatctcatttctggaccctctatttaatgtatgcatccatccttttgctaacactacactgtcttgataactgtagctttatcgtaagtcttgaaatacagtagcatgagttcaccaaatttgttttctttttcaaaattgttttgattatgcttagtcctttgcctttgcaaataaatgtttgaatcagcttgttggcattgacaaacattcctgctgggatcttcattgggatggcattgaggttttacatcaatctggggagaattcacatcttaacaatattgagtctttgatttcatgaccatagtatttctctccatttatttagatcttctttgctatttcatcagtatgttgttttcagcattcagatcctgcacgtattttgttagatctaggctaagtattttattttttggtgttgttgtaaatggtgctttttggctaaagttcatattgtttgttgcttgagtgtggaaacacaattgatcttttaatattgaccttgtgttctatgacctttcaaaattcagttattagttatatgatgttttggaaattccttgagattttctgtatagacaatcatttcttctgcaattagagatagttttatgtcttctttatatataaggcatctctatatatatatgacttttatttctttttcttgctttattgtactggcaaaaactttcagtgtgattttgaatgggagtggtgaggttagacatcctctcgtattcctagatcgtagagggaagcattcactctttcaccattaggtataatgttagctataggttgtttggttttgttttctagatgttctttatcagatccaggaagttcccttctatttctagtttactaagagttttaaatcatgagtggatgtttacttttgtcaaatgctttttctgcatctactgatatgattgttttgtttcttcatagttctgtcagtgtggcatgaattgtaaggattgattttttttggatgttgaatatttgaatgctttgcattatcttctctatatattgctggatttaatttaccaatatctcgttgactactttttgtcttgttcaattgagatattgatccacagttttctgctcttgtaatgtctttgattttgttagcagagtaatgctgcctcattaagatgatttgggaagtgttccataaaatgagttggaaaatgttctctcctcttattttttggaacagaatgtctacaacttgtatttttcttctttatatttttggtaaattcttcaataaaatcatttggtgattttttcccagaagatttttaaccaaaaatttaacttatttaatagctataaggactgtgtggtttatctttttttcttgagtaagttttggtagtttgtgttttttaaggtattgattcatttcacctacattgtcaaacctatgggtatgcagttgtttttaattatctcagtaattccttattgtctgcccttttgctgtcagtaatatctgtggcaatatcccttttccatttctgatattggtaatttgtgttttctcccttcttgctcagcctggcgagaggtttatcattgttattgatcttttaaaagaaccagtttgtagagtcactgatttttctctattgtttctgttttcaattttattgagttttgttcttatctctattatttccttccttctgtatgctttgggtttaatttaatcttcccctcttcctaatttcttaaggtatagtttagatcaggggtgtccaacatttttgcttccctgggccacattggaagaagaagaattgccttggtccacacatgaaatacactaacactaatgatagctgatgagaaaaaaaaaatgcaggaaaatctagtaatgttttaagaaagcttatggatttgtgttgggccacattctgtcctgggatgcatgcagcccgtgggttgtgggttggacaaggttggtttagattattaaattgagacctttcttcttttctcatataaacaattagtactataaatttttctctaagcactgctttagttgcatcaatgcgtgctgataacttgtattttcacttttactcagttcagaatatttgctagtttcccttgagacttccctcttgatccatggattatttaggagtgtgtgatttagcttccaagttttgggagatttccccaatgtctttctgttattgactcctagtttaattccattatgatcagaagacatatttcataggattttgattcctttaagcttgtgaaggtttgctttatgacccaggatatggtctgtcctggtgactatttcacgtgcccatgagaagaacgtgcattctgttgtcaggtggaaggttcagtacacgtcagttagatcttgttggttgatggtgacattcaggtcttctgtgtccttgttgatttcctatttctttctataccaagagagaagtgctgaggtgtgataattttggactggattctgggtgttttgaatattatgttgtgagatgctgggggctatgggctgagttgttgccccctccctcaaccccaccattcctatgttgaaaccctaactcccaataccttagacatgagtgtatttggagatagggtctttaaagggggtgattaagttaaaatgaggtcactaggatatgccctagttcagtatgattggcatccttataagaataggaaattaggacacggacatgcacagagggaagaccatgtgaagacacagggagaaggtggccacctgcaagccaacgagagaggcctcagaagaaaacagccttaccgacaccttgatcttggacgtccaccctccaggactgtgaggatgtaaatctctgctgtttaagccacccagtctggggtactttgtatggcagccagagctaactagtacactgtgtcttgttaaaacttttagagcatcgctttgttttggcagtttgggtctggtctgaaaattctctgtcaccttctataagcagtggttgcatgtcgtttgggtgtgtcttgcaggtgcacccctcaggggttagtctcgacatggcaggggtttgcaccatagttcagttatcagagcctttactgtgctcctttgaatctcttttgtgcatgcagtttggggtgagcccaaaatatgtacaggttcacaccacaaacttagggggttcccttctccagcttcctccctctgggttcccctgacactgtctagctcccatgggcctttctgtgtaaccctctggctgcaaagcctgcgtttctgcccgctgcatcctcatgtgctgctgcagaggtctgcactgccagggcaccctgcaggcaaagcagtgagagaaaatggaagagatcaagggagcccccacactcttcagaccatggggcccttccctggcttcctctggccagcggaactgtcactgctgccatcgcaaccgtggcaacacagctcagcaactgacactgctttgagaggcaggaccaggagagaaaaaagagaaaacaagtaaaaatcggggattcccctcaaactgccagctcacaggagcctggcttctcagtcttctgtctagagagagggggtttcttctagagcttttgtgctcagtcctgggagataaaaaaggcaaaaaccccagtaagctcatgatgcctgtctttctccaggtttatcttccttccccgagccagctgttgccgccttcttgccaggggcctcggccattgcttgttggagcttgcctgggcttactctatctgtgccggcaccgcaagcattttttcatactctcctagtttcataatggtcctgtgggtcccaggcaggagttctcatgttgagacagggaacagatccagcaaaagaagtggcccagtccagcaggcagactgggctggcaccaagatcttacatctccctttgggaccccttcaggtaccacccatcccttcaggaggacctgcctgcctgttcacggtcctgcagtcctgcccgccccagctcaggaggccgctgtgccattaagagcccagcctcccagcagttcctgctgatttgtaagagtccacaaatgggaaatgaaaactcaggtgctttccaccctttgctgaccctcctgctctgtggggcttcagccctccccgtcagaggacatttatgaggggatcagcgtgtacctagccatgcaccttccatttcctttcttacgttcccagtgtaatccacataaaataaaccagacccaaaagtggaaaatggagaaaatcaaaagagaccccactctggagacaccttgagacagcaggtccagctctctgccttgggagtcatggggccaggcagcaaggatgaaacttacaatgacagttcacgagcatggaacacgtacagccgagtgctgtgagtttctgtcacgccatagcaccttaggaggtggttcctgctcttatcttcattttacagataaggaagctgaggcattggatggttagtcacttgccctcatcatacagctaaaaaggaaccacgcaggagctcagtctcatgcctgattctgcagctcttataatgaatcccaacctgtgttgcctctttctagccgaaatgtcttcaccccgtcgaaatcccatcacctttttcctctctctgtgaaagtgcacatgacaccattttatgactgtgtgtgtttcagtctatattctttttaaatgttgagcccttccgaagtcatgagtaacccttggtgtgcctaatgtctgtctatcacttcctggtcttcctggtgcaagtgggcctttggtatttgttgaatgaataatgaaaggatggatggatggtattcaaatctgtccagcctttatgtttagaccacagagaccctgcgagaatttagtgatgagagaaattatctttagaatgtttgtacactaagtggagtcttctctggaattttctgatgtgctaggtcccccagagagcctgggccacagatggtgtgttctgaagagacaaaactgaaggcgtggtcccttgtacaaattctgaaattgctgctagtttttagattagccacatattgagttgtcagatgtagcaaataaaagatgcacagttaaatttcattgtcagataaacaacaaataattatttaggataagtataggctgtgtgatatgtgggatatacttatgctaatatgtgggatatacttatgctaaaaattgtgttgtttatttgaaattcgaatttaagtaggcatcttaaattttgtttgagaattttattgaagggtttatatggcaatatttgccacacagactctcactttaggcccgtctataactgacttcagccttcttagtattgggcagggacttctgaccttagatgtcaccccatccaagccactccctagtgtgtaaggatccaagacagggcagggctggagcagggccagatctcaggtctccaggcccagagcagtgtgggagcagcacagcccactggggacatggttgtctttacccccacacaaatttaactttaaaattcatagcccaggagcatcagattctaactgttcgaggccaggttgctgcagaacgggctcagccaagacaggcactgagactgcatctaatggaggagggtctggtggcccccgtatcacaagccatcacaatcacccttctattgttttgtgtttacccatcctctgaaaggcctgctggggtcacctctgataaccacgctttgaagatttccttctgaaaccgttttccgttcctttctctgtagaggtggagcttaggggagatttatataacggtcacctccttagtaggaacaggtggaggcctaaaggccaccccactccttggagcagcatggagactgttgggaaggcagggccctctgaggcccctggaggatgctgtcccattttccacaatggcccggaccacctggaacaccccacatcgcactcagccaccccatgctacatggtgccccgacactgcggggcagggaccccaagcctggggcacccttctgaattcagagagcacttaatcccacggccacaactgattataaccatcacgcgtttggtgcactccaatgctcaaagcactgctcttaattttaggaagttcaaaaataccaaaaaataacagacactcgtatacccactgaccagaataggccatttataatatttcatcatgtttgccttgtctttccttataagaaacgactgcagatgaaatcagtctgctttgtcccatctccccctttcccagaggcagccacgatcatgaatctggcttcacaatccaagttggtacttttactaacatttgtataaatccatgcatagtacatggtcatattatgcatgcatgtttttgatttcaagaatgctatcggagtttattttgtgacttgccttttcccctagaaagcatttttcatccagtgttaagaacctcccagcagcccccttctatacggctgtctttattatttcctctgtttttaactgagaaacctctgcctcagagagattaagaagtgggcctagatcacaccacgaggcaatgttggccctggggctaaatctcatcacgccctcaggattcttgactgatggtcctaggattcattcatttaccaaatattttttgagtgtctgctctggtctaggcattggggatactgtgatactgtggaagagccctgccttcggaaaagcgtaggcagaaaatacagccttctgtcttcaacaagccaacaagtgtttttgttttctttttttgagacagggtctcgctggcacgcagactggaaagcagtggtgccatcagacctcactgcagccatgatttcctgggctcaggcgatcctcccacatcaacctccctagtagctgggaccacaagtgtgcaccaccacactccgctaattttttttatattttgtagagatggagtctcactatgttacccggactgatcttgaactcgtagcctcaagcaatcctcccatcttggcctcccaaagtgctgggattacaggcatgagtcaccgcacccggccaacaaatgtttttttgttgttgttgtttctttttttaatcttgatgtgaatatctcctccgatagggaaacaagcccccctcgccccccaggtcaccctgtgttgtcctggttgccagtgtctaactcagcaagaagagactagttttcttgttctgccctcttaagccactctgtcttctgcacagtagcttttctagggtttaaggttaggctcacgcccccaaatctgctctgagtcaaaacctcatccaagaatcccattctctgaaggccagtggccacccttgcccactggcgtgagaaaaccctgttgctcatttccagcagtggcgtgccaccagaagggcatctttaaaagtggctaaaagtagactggagctggtcgggtgggctttgagagtgacattctctcatcacctgcttccaggatgacctcagccaacacccctcattctgaccacaagccagctcctgatcaaatttttgtaacttccaaatgatggaattgagactgactttttgtttttgagtcatggaattctgctgttggaagttattgttatgtctaactcagcactttccatttagaacctattttacaaagaaaaaaaatatcaaaacaaaataaaaccaacaaacctgagacagatggatggagcaacagggctgaccagctttggagcacctctcagccgcctgtctcagcatacactagggggcacgggtggccatctgctgacaactgaaaatgagtacctggttatcgatcacacaaaaagcacatgaccagaaatgccgtgttcctgatttcctcactttagcttaagcagctggataagagatgcatgtgatactgtcctacaaggacgacagagggaaggaatattggtaatcattgcgtaactgtcttgggccatgctttcttatacatgatcttattcactgcttgcaacaatctcgctggttggactgcattctcttcattacttatagaagggaaattgaggcaagtgggtaagtaactcacccaagctccaccatatgtggcaaagcaggattcagccccaagcctttctgacaccagaacccaccctcatttcccacgctctgagacagcagaatccgtcccacactgaccatcctctttggcagttctgagctcccactacaggtgcagggcaaaggggactccccatgaggcctgtcccacggctgggagctccaggattggggtttatgaagtaccgcctgtggggagcccttctgctgatttcaagttcattaattctgcatgcttttacttgtcactttttttgtatgttaaggatggggctgagggggtttgtgatgagtagaccatatccttgccttcaagagttctctgtctaatgggaggtggacatccagttatgcacaccatcctgactcctttctggaacggaagtctggggtatggtcagcagagtgatgcccccaccaaggatgtccacgtcctaacccctagaacctgtggatggattaccgttcatggccaaaaggactttgcaggtgtgattaagttaaggattttgagatggtaggagtagcctggattagccaggggagctcaatgtcatcacaagggcccttataagagcgaggctggaagatgagagagagagattggaagatattacactactggctttgaagatggaggaaggggccatgagcccagccatgagcccaggaatgtgagcggcctctagaagctgggaaaggcgagaaaacagattgtcccctagagcctccagaaggagtgcagctctgccaacacttcgattttagtctagtgagacctctgaaactgtatgatacattagtgttgttttcagctactgtgcttgtgggaattagtcacagcagcgacaggaaactgacctgcaaagctattaaataaatacctgccgggaggcagagaagggaggggtgcagaggctggagggcatcaccctgacccgtttggcaggaatgttaggaatacaggtgccgagtgcctcctggcaggaacccatcagaagcaggtgctcaagggccacctgatggcctggttggcgggagccctacaaaaggctctgtccaggttcccttcctctttccccagtgatttggatgaaaatactcatctcattcacatttgccctaaagagaagagagagacaggacatatgcccagagagctccatagggtgggagagtggctcagatcccattcgtggagtccagggagacatctgtctgagcagccagcagcatgggcctggtgagagagaagagacaagaagcaatgagtgggaagggacaggaacgctggttaattcctgggaatctggcaggggtcgcggggggatgtgggggcagaacaatcccctgcagcccccgtcatgcccaagaggaaaaaagcacagcttctcacactgagcctgctttccaagaggccaccagcaaatgttggtggctttaccttagcctggaggccttctgttgtggacaggttgggcaaaggcaccgatgatgtcgcctggggaaggggaagcctcccattaggctggcatgtgtctgatgcacccacaccccatctgacctgcaattcttttatttacacttataattgtatttttagcataaaaaactgttgtaatattcttgtttgcattggtcattatatttaattgaaatatagtaatagaatatgttatacatataagaagtactcatataaaaatgtaccccacgaggggtgaacacagcatggtaacctgcagcccccactcagaaattgcacctggcctgccctgagccccatagcagtcctttccagtcactgcactctctaggtcaataactgccctattccatcccctcaaggacagcaccatgttaggaatataggtgccgagtgcctcctggcaggagtccatcagaagcagatgctcaagggccacctggtgacctggtaatggtcatcctttaagaggaggccactgagactcaaggcaggccagagagcttctgagcagcagctgcccaggcacgtgtgtgcctctcatgttccaggagcctgaccctgaagcccatggggctgcatgcagagccgggagtgcctgggctcacagtcagacactcgtggcactcaaccctgacaccaccacagattagtgctatggccttgacctctgcttatccacctgtaaaatggggttgcagtattagcctccaccaggattgttgagtgattgagagtattttaatgtctctagcacagcccctgaccatagcaggagctccacacagaatactgtctcatgcggtgctcggtaactgtgcatccgatgcaggcctcactgtgtcatgttcattcattcaggttcccttcaaaagaaacattgattatgggccaaataggtgtcagtgccagcccaggaatgcacatgcatattctgcctctggagagggcctgggaagcctggacatgggcctcctgggctggggcaggaaggggcctcctcttcactgctgtgtccgggatcaccccctcccttggagcaccccacctcccacctgaagtctgagcagcagagaacctttaaaaacagaaataggaagttctgattcatgaatgcaaacattctggcatcccgtgtgcagtgatgtgcggcgtgggcggtgggaattagggaacctcttctagcgtatttgttcctatccaccggaaggtatacagtgttcatactcattgactcagaaattgtgtgtcggggagtctgccctaatagataacaatgtgtgtaccatgatgcatgtacatgctaatggatgtacaaggatgttgatcagtgcatcatttatcataggaaaagtggaaattgctaaatctccaacactaggggagtggttaaactgtggcttatgttcatgatagaataatacacaattgttaaaatggaattttgatggccattttgaaacagggattaaaaaacacgtttaaatgtgttttctctctgtctctgtctctctctctcactctgtctctctctctctctgtcacacacacacacacacacacacacagaggaaaaaaagattggaaagaaaaaccatcaaaatgttagcactgattatgtggtgggatcatgattctcattttttatcctgttttatattttcttagggttctatgctaagcatatattatttttaaaattagaagaggaatgaaggcattttacaacccatatcgttatggaggagcctggcatggggggaggggaatggctggaggggttgctgtgagtcctggtgagtcaccagctagctgttgggtgagttccttgatgctttcatagtagcgtgggcatgagaatgtctgcctcaaaaggctgctgtgaacactgatttttataaattaccatcaatgataaaaccacaaaagcaaagccccattttgcaggtgcagtagagatcgtagcttcatgtggggttgtttgaccagaccacttcccttttgcagggtacatctgcccaagcccccatggccctggataattctctctctccttctttgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcgtaggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctcccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaactcctctgtgtctggttctcatctgtgctttatgcaaaggagatgatctactcagctttaaatggctcagccccagcgtcacctccattctgatgcttttcctgccccaccgaggcaggacaggtcccctcctccctatcccctcctgataccactctatcatcacacctgtagcaaatcaaatcacggaagctacattcagttttcccaactatctgagccatctaagagcaaacttatcttattcaatgtgttatccccaccacccagcacagtgcctggctcctagcaaacatccgatattctgtgaatgagtgaatgatacctaaatgaccagcccggtacatttcaacactatgaggaacatggaccatatcattttccttattagttcactgatagtaacaaacattcgtatagcacttatgaggtgtttggcgcagctctgagctctttccacacatgttaactcacttaatcttcgttttacaaatgaggagtctgaggcatgcagaggtttcttgcccaaggccatgtaactggtgaaccaggactgaaaacctgattctgggtcagtcctgggcttaggcctcaagaagccttttttttgttctgtctttggaaccctgaggatgcaagcaaggctagcctgctggatgaggagagaccagagcctggccattcctagcctgccaacagtccaacagataagagagccaagggaggggttagaacaagaaggtgttccataatgtcaagagctgcatggactttgtaggcagcaactaaagagctcactgaggactgcctggaggaggcaatacttaacttggcatggaatctgcagaaacaggtgcacagcagaggttgcatggggttcgggctagaagaccaggctggataaaggtcaaggcagcagtggatctgaggctgctgaggatgaagggatacagccagctgaaaggggccttgaatgtcagggtgggcaccatggtgggccatgggccactgttggccatagggaagcagggctggttctcaagtagagaggcctgcagtttctggagcagggaggcagcaagagaactgggaaggggctcttgattttgcccctcgaacctgctcctctggcatcttccctcgctcgctggatggcacctccgccctgcaccagtgtggctgataaggtggggtctccctcccaatcgtgtgccttgcaaagatggcagaggctttcacatggcccaaaggactgcgttctcaagactgataagcatcattctgaaatagcaaaaatggctagcagcaaggtttttcaagaaaaggaggcatccctggtccaatgctgctgaatgtgtctcaagaagctacagccagtccagcccaggccacagcgtgtccctcacttcctgccccaccctccttgctaacatttaattgatttaattgaatttttggttttaccaatcaggattgtaaacacattcatcctcatgcaatgtgcctattcctagtcaaccctggtattgtaagggtatgggcagctttcctggagcagaatgtccatctgtaatgtggggcctgtaaagaaataaaggttcaaacaaccacagctcttcactctgtccaggagttggttatgctgtgggtagtggggtgctcctctcccctagggatgagccggtcccccattagctgtgtactcttggaggggtaatgcctcctctggctcacccctttgtcctccccagtgcccagcccagggataacagtgtcaggctttccataaatgaactaatgagggggacagggatgaacaccgcagcctcccttcggtgcctgctggaatggccaagctctgcatccgctccccagagctgcctgagcctttagggttggaggagggggagaggaaggggagggatgggtttctagggctgagatgggccccttagtgattctggtggggctgcctgtttatttagctgcctgctacccatggtctccaaagcctgccctcgctggggattttccatctggcttccagtgactcaggctcccgcagggtgctggccttaccaggcagcagagatggccccacgattaatattgatacacgccagctgctgaggcctctttcgcaagcaagacaaataatattaactaccacagcaaccggcctctgagccgcactgcccttagggtttgcaagcactttccattccagctttccatcctctgaacaggtgatctgtgtcggcccctcccatgccccaagcacaaccaggcagggcacctactctctgtcttgtgtggtggggggtggggggaggcaaaggatcagatgaagacaatgggttgtaactgcatgatagtgagaagctgaaatgcgccggggctgaggggcgcctcctaaccagcctagcactccaggccagaacgccagggagacaagcctccagtttttagaaaacaaaactgaagttcatcgacttgttcattcaataagcaatgactgagcacctgctatgagccaggcactgttctagacactcagggtgtatagtgaacaaaacaaagccccaccctgctgatggcaaagggaaggtagacaagaagccaataaagaaataaagatcaagccttactttctgaaaaaccaaaagaaagaaacagtgaaagaatgcgctatggaatggagacaaatgttgggggaaacagaaagtaagtgtggggctggagcgggaggggcatgaggttttggagaggatgatcaaggcactcctatccccaggggagaggtggtgccagtgtctcaggacagggtgacagttcagagaggtgacctgacaacgtgcctggccaccccaagcttctggatagagagagttttgtactcagttcttacagagtattgtcttgtcccagaagtgcttttggaaatagcatcattcattcattcattcattcattcatccattccttcactgagtctctactctgagctggacaggcaaggatacaccctggctcctgcccccacggtactcatggtccaggctcgaagtccctgtgtcatgatcatggttggggcagcaggacccagttctcccctgagattaagtctcagaagacacctggttaaccagccaaagtctgcatgagggtgacactggctggagagtgccgcccacagggaatgctcaggtggtgccttatacctcgttggagccttctgagtgggaaaggcacctccctgtgtggctcctgcaggtgctgctggggcctagcaccctagcacctatctcaagaagtcagacatggctgctggggcaggtgcatgctggtcttggactctcagcatctgttgtcactcctttcggtaaagcatgctatttcctcttggggagccacaatccgcagtctgtgtactcgatccctcctgggcttggtagcctgaatgccccatggtcacaatgatatgtgcagggtgtgtgcctggctctggcctgggcagtggtgaccttgcaaccccctgatcccagtggctgggccaggagtgattacacaaccagacagatgcaggcagcacagatgtcctgacttgtaagcgagcactgggaagcagtctgcacgggggaccctgtctctctgctggaaggaaagccaggaggatgtgcgcctgtcttggcagctgccatctcaccgctgtgagagaagctgctgagagtggaggtgcagcaagtagagcccagagatgggaagaaagagactggctcctgctgggtctaaccggacccctgtggatcaaaccacatctgattctccttatgtaagctgatcaattccccgtctacttgaaccggtttgagttgggtttctgccccttgtcatagaagggatgttggcgatactccttcagtgcactctggccttcaccccacatggggatggccacccccaggttgaggagctctagggggccgtcctattcatcctcggccatcctgggctctcctgcctggctgctgcctcactctatccctgctgtcacccagttccctttgtccctcgaagcttgaactttgagtccagccacaggttcagcttttctggctcgacacattgtccttggttttggccttatctgctggtttctgatggcctcagatactgtccaccaatgaggctcaacacctcggacctgaccccagaattagcctgatcctgcctccaaagaattacaatttgtcaaacaaactccctcctcatttttgtttcatgccagtagagtggggcggggggctgccccggtacagccctctgtcattactgctgctctgggaagcctaacatcaccaacattatgcatcccacttcgtagtttgcagaaatctttcatgcagtggactgaatatttgtgtcaccccccgcaaaaaaattcctatgttgaaatcctaacccctaatgtgatggtattgggaggtggggaggtctttggggggcgattagatcatgagggtggagccacatgaatggaaagttctctcatcaaagggaccccagagagctctctcgcccccattctgccaggtgaggatgtaataagacggccctctgcaacccggaagaactcaaccttgctggcactttgctcttgcacttccagcctctaaagctgcaagaaataaatctctgttgtttctccaagctaagacatctcacatacattttctaatttgatcacacaggagccctgcagtgcactgcccagatgccctgggagggctggtgcattttggtgtgcccccctcccagcagcagtgtgcctttgtctccaactgcaacccctgcagcctgccctctggctatgggtccagcagctttgcccacacaggagcagccaggaaggccaggcagtttgctcccttcctcctcccacatggtggcactgatgacaggtgtcccagctcctttgcctccaatgggctctaacaacttacaccccggagctccctgcaggaccaagctgaggctgcccccagcaggacattgcctgaaactgctaccctggctttgcttcctgcaaacatccctgtttcccagaagcacttccttaataaatcacttgcattgaacccttatctcaggtctgtttctggggaacacattgaaagaaatggccctaactcccatgagagctagatatgttcttctacattttacagatcaggaagctaatgctcagagaggttaagcaacctgtctaatatcacacagccagtgagtgacagggtaggcttcaaactcagttcttctagaccccacaacccaaggcactccatcctccattgattaattagatgcctgggattgcaattagcaatcaagacttcagaagctggacattaacaccagagccttagagagctctctgcagcccagagtcatcgtaaacactggccacagcagccacagccctgagtctcatctgccctctctcccgagccttgtccatcctttttcttgctctgtaagccaaccatgtggatcccaggatggaacccttcatgtccatccagatagccctgaagaggagaaacacagagccccagttgctgcagggtctgaacccaactgtgactgtttctaccctgtgaaaaagatacttgttgggggaaggggggagggatagcattaggagatatacctaatgtaaatgacgagttaacgggtgcagcacaccggcatggcacatgtgtacatatgtaacaaacctgcacattgggcacatgtaccctagaacttaaagtgtaattttaaaaaaataaaaaaaaggaaagaaatgaaactggtgaaaaagggaaatgtataaacacatactacaatggctggctcactaactgcagtcgtctgagatactgcaatgaacaaactaagtattttgagactttctgtcgaaaactgtgatgggtcaccatgatggtgaccaaagagccgagatcccgagaaatttcattcttcatacgtgcagatgtacaaaaaggacatctctccatttactgaggaagtttcaatgttcgtacgtacgtgggcaatacttatacaaaatgtcaatattgtgataatgtgcttttgtagagtcaaatttgcaaaaaaagaaaaaaaaaaagaaaaaggtacttgttatgaagccactgacgaaggttttcttatatccattcaaggtttccccaccttgcagtgtgcttagggttccttttgtttgggggaggggacaagaacactactgggcaaatgtgaacatgaaaacaccatgtgacggatgaccagtcagtcacaggcacgtggctgtgtgatggccccatgtgactcctactggctggctccaagtgctgctagaagctggatcagaggcggaatccttggtgggccgctcagagccgtgagcacccgggctcccttacacgcataggcctgcagcatcagggggtcgtgtgagctggggctgccttcagaggagctcgtggcacggccgagatgccctcccttctcccttacctacactaccctcctccctacctccctcctccctacctccctcctccctccctatgctcccctcctccctacctggactctcctccttcaaggagtattgtttgtctgcacctgtgctgacgctcaatttttgactccctggaggaacattcaaaatcctgccttgcccaagaaactccaaaacatttaatttattcccaaaatttgcctccggggcaattacgagttactgggcctagaaaatcagtcggatggaaaaatgcagtgagccaggaccagcaggggtcagtgtggtattagggatgggaacagaccccggcagcctctggggtcagtgggttgtcgcccgctggtggctgcaaagaaaaacagaagaagctctgagattccccccagtacctttcaggaactcatgttcccatacgagaaataacccacaaaccacgaggtcccagagaggaaattaactgataactccctgggatcaccctgccccacccccaaaataaatgccaagcaaaccttctaagccagaagccagacaggtgaacaggccgaacccggtcctcagacctcctctgatggaactgggcatggctctgatttgtttgaataaagctttgcattgaagtacaacatacagaaagaaaactgtgtataccgttcaacaaattttgacgacgtcctcatactccataaatccagaaatggggccaacaagcggaacattctcagaaacgtcttcagcctgcaccttgttgtgaaactcacttaaattggttgccaacaataacagtaacagaaaatttggatttctgttttttctggagaaaatggaaagattcacacagcggctgcctgcccgtgcttggaacagcagttcatgcccggccccctagcccagggaagaggggagcctgccctgtgccctctgttttaaaggccctccctgtcctcctcttacatggtccttccccacaaggcaaggactccaaaggccagaagacatgtccacctggctctgtcctcccccttctagatcacacttctgtactcaggaccccagaattctgtctgtgtttgtatttttgagagctgactgccatggttcaggagcagctgtctgtgacatgaggaaagggcatgtccaagatgttccagctggccgggcgcggtggctcacacctgtaatcccagcactttgggaggccgaggtgggtggatcatctgaggtcgggaatttgagaccagcctggccaacatggagaaaccccgtctctactaaaaatacaaattagccagcacatggtggtggcacatgcctgtaatcccagctactcaggaagctgaggcaggagaatcgcttgaacccgggaggtggaggttgcagtgagccaagattgcgccattgcactccagcctgggcaacaagaatgaaactccgtctgtaaataaataagtaaataagtgatgttcaagctgtggatgggaagacaaggggggcagacctggggccaggcccactgtcctgggctccacaccccagcacagcaccctaaaaagccactactagagttcacaagagaaacagaccaatatagtgtgtgtgtgtgtgtgtgtgtgtgtgtgtgtgtgtgtgtgtgtgtgtgtgtatgcgtggggttgggggagagagagagatttattttaaggaataaggaattagtttgtgcaattatgggtcctggcaagtagggctggctgaaatttgtagggcaggctggtaggccagatattgctgtcttaggtccacattccacagggcaattgcctggaatctcaggcaaagtttttgtgcttcagtcttgagaattccttcctcctgggggaaagtctatcccctgaggccttcaacagattagatgaggcccagccacatgatggaaggtcatctacttaactcaaagtctagtaacttaaatgtcaatcacatctaaaatatacttgcacagcaccagctaggctgggtttgaccaaataactgggccaccatagcttagccaagttgacataaaagtcaccatcacagattcccagaaggctatattcaaacccagccttccttctagggtgcaaaggtgcatctgtccaggtaaaaggagagagcatattttgctcacaattcattagctgaatcatatctttaaaacgtttcgacaaatggcatgttgtcctgcatttgtgcagtagccctggaccagcatgagttaatggaagcctccctgaaactccaggttgttctatagcagctggctttagcttcatcttgcctgtctggccctgtaggtgttgtgtttgcaaccctagacttaaagaataacagttgggagagggatagaggggatgaaattattagccaggctattaatttcagactggttctagttctgtgaatatttatgaaatcccatcaaagtcaccctgcccccacctttgtattggctatggtggtgggggatgggaggtgagggattacgattctgtttcctgggagtacaatggaggaacatcctatggatttaaggagatgatgtcagcagcaggccttactcacagtgtgtgctcacagaccctagcaatgattgccactgtgggggctcactgctcaacagagcagcccacctcccactaacacccattccctcatggttggaagagttgggcagggcctcatctgccttagagttctttagggagcacctttctccttgtttagtatttgggaggaggcaagagagaggaaagtgcactaaggagaggccaagtctggcccactgcctgtttttataaataaagttttattggaaacacagctacacccatgagtttagtccttgtccatagctgtttaagtactgcaataggagctgagtcgttgcaacagaggccatatagccagcaaagtaaaaaataattactgtctggccctctatagaaaacgtttgccaacctcaccagagaaggtaattctgagaattagcccttcctaaagaccaggcaaggtcacctggctagtccagcaggaaagtctcacttcttcaccttcccttttgtcatctttgggggcagctgcccctacggagcttaggaggaagcagttcggtacacagctggcacagagaaggcagccccacaatcatttgtcctatcatcccatctttaccccaagtaggtcacttatcattagcccttgggttaacagagacagacggaagcagccttggaagccacatatggctgcacagtgacaggttgtcactacacagaggcatctggcccaggggcatccaggggctgacgtgcagattgtgccactcaccaagctgtgtacccagtgtgggccacctgtgcccagaggacaaacacctcctcttagttttcataaaagaacccatgaggcatatgagctaatgtggttgccctccaggggctgggctggatatccatcctggctctgaccttgggcaagagacacacattatctgagcctcagtttcctcatcagtaaaatgggagcaagagtagcactgtgctaggctgatgaaggccctccaaagataccccttgaacccatgaatatgtttccttagatggcaaaagggactctgaagatgtgactaagtcaggatcttgagatgggagaccatcctgcattatccaggtgggcccaatgtcatcacaagggtccccatgagagggagcagggggtcagagtgagctctcagaatgtgacaaaggaagccagaggttggagtaacgcaaggaaggggccacaagcccgggggtgtaggctgcctttccaagccagaaaaggcaaggaaacagattttcccctggagcctccagaaagacccagccccaccaacaccttgactttagcctagtgagactaattttggacttctagtatcagaactataaggtactaaattgatgttgttttaagcactaaatttgcagtcattggtgacagcagatgtaggaaactctaccacaagcacctcccctagaggatcactgtagggatgaactgagatgaggcctctaagcatccggtccctggggcacagcttggagctcagtaagtgggagccactgccactcggtcaatactggggcttccgaacctctgcccctatccacctcctgcctctttccggccccaggaacctcctgggggaaacgaggagtgacctctgaccacgtgaggaagggaaggagaccatatggtggagattacagtcattgcatcctcggccccttccagacttgcccaaccacgggaggcaggccaggtggccgtgaagtcattatttacatgcctcggcttgcgtcattggtttcgagtgcagccagcggtgaaagcaaaagttcatctcgggctggtagtgggtggccagctggccagatcattccctgcagtaataaaccaggcagggatgcagtcaccccgcccacagcctttccctgggctgcttcagcccgcaccacattccgggcccagctacagctcgtctctcctctgggaggcttcgcccagtgacccagccccagggtgaccaactcatccctgtttgcccaggactttcctggttttagcactgaaagccccgtgtccagggaagcccttaggtcctgggcaatctgagagggttggtcaccctactcagctgtcagtgtggagagagcctgccccatggtacttgatcctgctccccagtacaggacggccttgttctctttagattctgcctggtctcagggcccgccccatgctgaccccccacccagcatcttcttcctctggtttgccatggctcgccctgccctggggcccggaccaacccactttgttggggtcactgctcctgtgtctttctcataggccttcactaccttccagctacatatttgtccccaactagatcgtaagctccaggagggcagggacccttctacttgactcaggtccctgaaatcctcagtgcctgccacactgcctggcttatcactgcacctcaaaatatcatgtttggaggatggaggggaggaaggaagaaagaaagaaaggcaggaggagaatccccaagtcacctgtgtccttcggactcctagcccacaatgtgactgatgttacagaaaatgcgctccaggcagaagacaggctgcttggcatttagctgtgcggtgaggaatggcctgatctggctggtaggtgagtctaatgggctggagagcaacgagcagcggggacgcaccgggagctcctgggacttcaggctcccgtttttcagatctcttagacagagccttgccccagaaaccgtctgtactgagacttcacacaaggccccatctgtgtgtggatataaaccagagcagctgagaaacccgccctcccctctgagacctgggcaaggctctggagcacagaggaggaggctggagcgcatgcactttgatcctccaaaagggagctgcccccacctcagacacccctcccccaaattactgaagcctatccccccgcccccccgcttactctgtgcaagcagagtaagcttcgtgtccatggcaatgaccatggccttcaaagttcctcttcccatcctcctgtgagatgccagggccatgtgcggggtagtcctccctggagctctaggcggggccaccaggactcacctcggagtcatgggtgtggagaccgtaaggaggctgtgccagagcaggctgcaagctgggcgggatgacaatgtcactgcccacgtgcgttctttctttcaggcgttccctcagcaacaactcattgagagtgtgctgtgtgccaggcctagggcgggagagctgacacacatcagcggagaggctgccctcatctagataaaggttctccaaaatgtaatcactgggcaaaagtgcaaatggttgaaaaatattgacgtaatgccatttagaagatggaaaactctgctttgcagtgtctgtgcgtccacagatagaaatgcacagggagaaagtgggacccaggattaccctggggagaggactgggaggtggacatggtcaaaagagccttgactcgggtttttgcacagagaacatgtacacaggttatctgtataattttttcattcacataattaaatattgaaaggaaaagaaaaaacaaggccgtagggcagttctgatgttgtacccctcaacagcaactcagaggtcatcttccagtttaacaagaaagacaaaatccctcatgtctgccaagatctttgccatttacaatatagacacacaacagccagatggacagataatacagctaccacttagcttttgctgggcttaaaaacaaaacactccaaaatgtagtcacttatagccacaatcatttttttagctcataattccgttggtcagctgggtgatgttcctagtctgggccaggatatttgctgatatttgctgggctcccccaaaagtcggtgaccaggtggcacctggatggtctagaatattccaactcctatgtctcctcactctcctctgcctcactctcatgacccaacaggctagctcatgcttattcacaggataccaagagaggtgacgggtggggggctgcgaggcacctgggggccccagctctgaaattcagtgtcccttccacacattccattgctcgaagtaagtcgcaagcccagctgttgccaagtggtgggcaatagaccccaccccaccctgctaactaagaagagaaatacctcctgtgtgctagaccctgtgctgagcattcaagatagattttctcattatcatctcataggagccctatgaggaagttgtataatttcactttatagatgaagaaactgaggcacactgtgggtgtcagagaagggaatctctccgatggactccaggaaggcttctccccacccacaaactctcccctaaggatgcctcaaatgtcaccttcccaactccctcatgctatgaactagattgtgctcccccaaattcatatgttgaagccctaaccccaagtgtggctgtatgtggagtaaggaagtaattaagattaaatgaggttgtgagggtggagccctgatccaaaaggatgagtgtccttgcaggaagagacgccagaggtggagcgctctctctctctctccacactcccctgcaccctgctgcccgtcttcatcatttaaggacagagaggcagctgtttgcaagccaaaaagtgagcccttatcaaaaaccaaactggccagccctttgatctcagacttccagcctccaggactgcaaggaatacatttctgctgtttcagctgcccagcccatggtattttgtcacagcagccacagcagactaagcctcctccctcccctctctgtcctcttttaaaatgcagcgccccttgatccatggtcaagcgttccccagtccctcaggtgcacctgttgttcacttcaccactccccttcccatgaagacagactccaaaatgttcccaggacagtagatttctgtttagaacccatctcagccccaatttttctctgctgtttctcctttttacttctctacttggaagacacaggcttagcaatgactgctaggatccaaagggtgtttcttaggtctaagggaaactggaagagaaatagttctgacacaccttggctgtcggtgggtgtcagctgtgaatatttcatgcatgatgggaatggagagggaacagagctccacctggcagtgcaggtgcccctgtccccacctgcctccactgctggagcccccagctcctctcatgcagtcaagggcagaggcactgatgctcagacctcttctctcaccatcagccatatcacctgggtggggacatctctcaacctctccagccctcagtttccccacctgtcaaagagagacagcaatggcactttctcctagggttgctgtcagcattaaataagctatcacccatcaagttcttagggcagtctctgacccccaggaagaactaatgcgtgtccactgtggtacccacagtgttccctggaggaaagggctggggggcagggacctcagtgctgcccacacgcagagtccagcccagacctcccctccctcccctccccacggtgtttacagggaaccccctgtgcatgggaacagagcacgggcatgggctttacccagtccactccttcctcttcacagctacactgtccatgttcctaggtgggacaatgaggctaagaaacttaagtacttgtcccaggtgacacagcttgtgacacagcttgtgaactgagactcagtctcctactcatgtttctggtttcctgggatcttgtaggcacactgtgaatgaggagagaggaatcctggaggttgttcagcgtcagctgccactgtgcccccattgagaaccagtctcagcccgaattcagcgacacctgtgcacttgccttcattcatgtcctgccatggtgttcactgtgagaaaaacagagacctgggctgattcagttcccaccacctatcattgaggtaagccgctcagcccttttgagcctccatctctcaagggtaaatgggctgattaaacgtactgacacatgtaatcccctggccttgcaccgacgcacagggtaaatcgaggattcaagggtgaatgcggatccctctttctcagcttgaaacaccacacctatgaggttagcagacctcctgggtgcgcccacggcacccaccaacacttcccacaggttttggcacatagtaggtgcttaatacacctactgaaatagagacggaattgtattagtaggggcttaaattagtaggtgctgagatagagatggaatttaattaagaaagtatttgtgtgaagtgtttccaagataaatggcttttttgattgtgtctattcttggaaaacaccacgtgtcccagaaggggccaccggagggcctttatgggcactggcgtgacagatcggagatttagaaagaaatgcagacagatgaggtgtgggggtgctggggtgggaaaaactgaagagagacaagttttggggtggggcaggaagaccattgggtggtctatgccaggaatatcatggccactgtgggacaggtgtggaagaggccagtagagccaggccttgggcttcagggcctgcttacagactcaagtccccttctgagctgggtggctcaagcatcttccttcctccgtaaaatggaggtacgacaggtccccatctgtgtgcacatagtgcaccgggactgatgggcgcacaagtgagtactggcatcattgtgtgttgacaccctgcagccatcttgtgggaggcagctctagagtgcaggtacagttctgcagcctgtgtggatgccacctctgctacttcccccacaggaacttgggccagttggttaacacccctgagaattagctctaccatctgtaaagtggggatgacacctgctctctaggatcgtgtgcagattcagttggtaaatgcttggcactgagtaaatgttggacagaggtcactgtccttcctggttggactcaaaagatgggggaagaggccacatgtcccactgcctccggctgcctgggcccagcatttcacagtgcttttgttctctcccaagaacctgggtgcaggccctgggattcctcagtaggaactcctccagaaactcactgggaaacatcttaatctgcactggcaatggccaggggctgagtcaaaggaggggaaacgaacattttggaagcaagtgtgtcagccgtgggtctcattcattgaaagatatttgaaagcctctttatccagcctggatgtggccttttccagagatcagaatgtttctcacttcccagtgttcctgagaaatcatacttggccttccattgaataagcctttattgagcacctactgtgtgccaagaccagcgctcaacactaaaaagacaaaagtgtcctctctgtcacttgttcagagcacattcctgagtgcctgcatgcactgagcacagtgcaaggcccagaggacacacagatgagatgcccagtccatgccctgaaggacaccacagttccaagtgcaaacagcaagaaacacagcaagcatggaaaagccactcttgtctcctactggttctccagagccttctttcatcctgagtgttaatgacatttcagaaggagcaaagtgttcagccacaagccttcatggggcaattccagacatcccaggaaaagccatggaaaatatgggaagtgggggaatggatcctctacaaaaatctctgaacgtcagaccacatacatgatagctaagagccagttcatccatccattcagcaaatattcactgagtgcctactacgtgctgggcacaggatcaagagcttagcatccaagtcttacttgttttcacttcatctcagacagagcagaggctacagttctggaaatctacaggcacatcccctgcatcatgggcactggctccttatgtgggagcccaagaagcatatcggagacccttttaagaaagcaaccactttcctctcaggagacctattgccattattaattcaagaacatcttggagaaatcacttgcagtctgggatgctggtttgtgcagaaaaatctctccctctcatatgccatgtggtcatctgcttctctttaaagcttttagataaataagccccacatcaacttggcctccatttctgtagctatggaagtggattctggcttgaatcacacagacatgggtttccctttggaacaagtcacatggttgacctgtagcctcagtatacagatgagaactggggagttggcaatataaattattgagaagtaccatgaattgttcttttttcagaacttaaaaagaaaaggaaagaaaggcagaggatagaaacgccaatcagttcagagtttgcaggtggctcccaggaatagctccatcaaggacctgccatggagctccagaaggggaagttgctggtaggagctgaggacacaagctcagggtaaccatagtagctcccatgtagtgcgtgccccccccacccccgctgctcccatagaaattaccagccaaaatttgaggtcctgacgtgttgacatgtgaaagcaagaggaagggagttcctaggacagaggagagaatgttagcagtggtgcatccacaggggtctgcagcaactcaattcttgcctcctctggggaaaatattcatctgaggggcataaggcagagtaagagaccaaggcaagttttagaacaggagcgagtttattaaaaagttttagagactgggtgcagtggctcacatctgtaatcccagcactttgggaggccaaggcaggtggatcagctgagttcgggagttcgagaccagcctggccaacatggtgaaaccgtgtctctactaaaaatacaaaaatttgcctggtgtagtggtgggcacctgtaatcccagctactcgggaggctgaggcaggagaatcatttgaacctggaaggtggaggttgccgtgagctgagactgtgccattgtactccagcctgggcaacaagagtgaaactccatctcaaaaaaaaaaaaaaaaaaagtcttagagcaggaacaaaacaaagtactcttggaagagggccaagcaggcgacttgagagattcagctcccatttagtccttgacttggggtctttttacactggcatttttcctggatccccatttctcctcctccattcttccctttgggcaggctgtcctcatgagcagtggcctgccagcacttgggaggggctgcatgcacaatacgtttagtgaagttgcatgcacactcacttgaagggtttttccctaatcagtccagtgttcccagaggaaggtcgtctaccagttaaactccaccattttacctcttagtgcgcatgcttgagcccactcacccaactcccaagatcttattgggaagctgctgatcaccagcttccattgttttcagttgtttttgctgttccctagtgccagctgtaaccagctattatcttagcaagacagtttaacaactgcctgaccagcacctaatggttgtctgacattcctcggtgtcagagaagggggttgggaaggcagtgctctcctgccctactctaacattttcccactcaagagtccaagacccaattctttgggaaacgggatgaaggtcagtcttctctaactgcttcctgctgacagaggggtggtggtggttgttctgtgggtcttggactcttgctagctgtcagggcagggtggctccatgggttggtgaaagtggtattcagccaggtccaagggaaatgggcaggattttatctctgtcgtgtccctctgctgggcagtctaggggtccgctgtagaagggtgacttgaatattgagaggatggcatccctcactgaggatcatctggagcttgatgacctgaaggcaagaggagataaatggagttattagatttagaggacatggaccaaaaaggagcaaaaatcagactaatgaggggaaccaaaaagagaagaatccaggataattatttccaggttcctttccaattttgccaactctgggagccttgttcctgtaaattggaggctcaatttaggagttgtctgatgttgtcttatacttttcccagttgatttacacaaaagcatcattttttatctaaggctaaacaaattgtactggccattaacatctctagtccttgattgttttggaggattacagctgctaaagagttgatttgttcttgcaagattgttaaggttttggccatggcctcaatgttgttgatttcctttgagagttggctgtaggttaaggagacttttgtgattccagcaattccagctcctgtactggctatgatgccaagtcctgtgagaaaaggaattaattggatagccctcttcaccctgagcaagatggaatgccagtgtattggtactggaagaaagagattgccaagggctacaaagatgttcagggatacatagtctatggtataagtttcagtccacttagtgggaaggcattggtgaactgattggccacaaacatagaagactccttgagttttaagacaagtagagatgttgaaatgaaatagagtctgagcctggcacagtggctcatgcctgtaatcccagcactttgagaggctgaggcaggtggatcacaaggtcaggagttcaagaccagcctgaccaatatggtgaaaccccgtctctactaaaaatacaaaaattagctgggggggtggtggcgcatacctgtagtcccagctactcaggaggctgaagcagaagaatcacttgaacctaggaagcagaggttgcagtaagccaagatcgcaccactgcactccagcctgggtgacagagtgagactccatctcaaaaaaaaaaaaaaaagtctgactctttagctaggggtcatagctaactccatattttcctaagctttacttagaatttaatggctttaaagcaggcaaattgtacagttattaagagttatagtagcagtttatgaccttaaagcatgtagtatacctaatgacctttgaaactgtacaatttttataaattccctttcacaaatcttttcacaaattacacagaccagctatgacatgcttggactttctgacttgtcctaaatatccatcttttaaaacaaccagtcattttactgtatggcaagaatttaccatacaagatcctttctcatataaaatctcatttctttataatgttccttaccaaaaatacctctgtacctttataacctttgaattaggcaaaagtcattttccttctattagaaagttgctgcttgcactacatgttgctgtgcaagtcctgtgaaggggagcagataaggaggttatctacatactgtagaagttatcccccgctcaagagattgctcagttagatttcttgctagggcttgtctgaataagtgtgggctatttttaaacccctgaagtaggactgtgcaggttaaagttattggttaaagatttaggtagctttcccaggagaaacagggctattagagggaaagatgaatttagaggttgggtaaatattaaggaggcacccatcttggaaagtatatttttgccccaaaggggagtgaatcttttcttttggagggagggggtgcaatttgtccccactatccaatatgattgggaagagagttgctcagagaaggagattagcacagagtaggcagctcttgaatccaaaaggaaaatgtataattttacttgacacctccaggagttgtccttggctttgtcctattgatgatgatgtctgatttggaagccagttgagtagagagccccttcagctcacagcattcaggggctgggattctgtcccagcagtcccatttctagtggatgagcttgtggcagaggggtcaaactgtgagaggctttttcccatttatccccttggaccagtttgccttccagcagcctggcttcccacaccaatggcagttacctggaggagtggccttagggcagtctggaggggctgggggcttgtaaagcagccaatatgtgagcagcctcttgtccttgagtttctcctttttcttagccctgtcctccttgtcctgatcttggttataaaagactgaagaggctaatttgaggatttcttgcataggtgcactggattctaaggctgacttttgtgatttttttcccagttcatttttaggccaaacagtattactgaggaaaactagttttttgttttaaggtttgggagatcaaacttttcccagttcttagggatgcatccaaggggggtgtcctgtggtatggagacacaattcctcatctgcaaagagagaacagaggaggaaaaggaaaaagaaggtgtcccctctgttatccttttctgaacatggcatcccccattcatccttagggttccagaatgagccaatcttactaggtacccttaacctcggtcccgattatccacttgagaacagaggagatattggagtcaacaggggacagcttgttcatccttggggttttggaagaattggtcgtgcccagtaccccaaccttgccttcatctctgttctaatgataatctgttctgttcctgtagcctgggatctgtcttcaactctgtcctgtgggtactttttttttttttttgagatggagtcttgctctgtcacccaggctggagtgcagtggcgcgatctcggctcaccgcagcgtgatctcggcttattgcagcacgatcttggctcactgcaacctccacctcccggtttaaagcaattctcctgcctcagcctcctaagtagctgggattacatgcacctgccactgtgcccaactaatttttaaatgtttagtagacacagggtttcctttttttttttttttttccagacagagtttcactcttgttgcccaggctggagtacaatggtgcgatcttggctcactgcaacctctgcctcccaggttcaagtgattctcctgcctcagcctcctgagtagctggaattacaggcatgtgccaccatgcccgcctaattttgtatttttagtagagatggggtttctccatgttggtctcaaattcccgacctcaggtgatctgcccacctcagcttcccaaagtgctgggattacaggcatgggccaccacacccggcctagagacagggtttcaccatgttggccaggctggtcttgaacgcctgacctcgtgatccacccacgtcggcctcccaaagtgctgggattacagggagccaccgcacctgacccttatgggtacttttgtctcttgcacctgtggccttgggctggcctatatccttgtctccatgaccttatagcgactctcactgggagaaacaaaatgattatctcttttctcagattcccatttcccatgttctttaagtagatgagaagcctgcttttttgccaactgccacaaggggctggactttcctccctttgaatgtgaccttgaaggtcttgatgcatattgagaagggcatgggagtgattagagaaatgaaagaaaatttgtatttggggttcctcatcctcccagggcaacacgcagaaaaaatgcttaagcagacaggacaatcctgctacatgaggaagtgggaagaggtgagaatgacactcatggaaagccttcatatgctcgcaaaaacagcaacccttggatttcagagcgcaacatttatttaccctcttgacataaagaaggaacttctagaggacttggggcttaggataagggcttcaaatgtcaaaggaggaattttctgtcctcccaaagggatgccaactcaaaaaaagcaagtaagtgggatccttaaaggagtgagagtgaggccctatgcaggtgacaagctgtttcaaaagccaccaaaaaatcttggcccttgagtgtaacagggatgaaaagtgtatggtaatttacaaggagctggcagagtgtggttgcaattagtgtctgtcctggcaatgagccaacagacatttgcagggagcccatgtctttgctgctgcacaaatacagcaagagccgcgggtgcacaaatcacagggagtgtgtgttttaaggcagagaaggaagtcagacagcatgcaaggtgaaaccagagaagaggcagacctgcccctgaggcagacagtgcagtgggtgcacaaggctatttcaaaacacacttagagaaaacaggagaacaggatgtgcaggttttttgagaaagaaaagattttagttaaaatagcagaggaaaccccagacattccatggtctcaggccttagccctaccactctcatgagcctcttgtccaggagagctatcagtgcctcaggtctgcttgttgcagatgccaaggtccttcctactcccatgagccacctgtcagggtgagctgagagatcagcctggggtaacagagccactgtgaccgagagggattgttccaggggttggttagtaagcaggagtgtgaaaggggagacgaaaaccacacacgggggttaaacaaccccagccaaagaaggcaaggcttagcagtatcttaccactggggacgtatctgagtcacgacaccaaagtatgttagcagcagcaaatccatatgggtctgcagcaacttgattcttgcctcttcaggagaaaaaattcatctgagggacataaggcacagtgagaaaccaaggcaagttttagagcaggaatgaaagtttattaaaaagttttagagcaggaatgaaaggaagtaaagtacacttgaaagaaggccaagtaggtgacttgacagattcaagtgccatttagtccttgacctgggattttatacattagcatgattccagcatctgcatctctcctcctctgattcttcccttggggtgagctgtcctcatgcgccagcacttgggaggggctgcatgcacaatgtatttactgaagttatgtgcatactcattttaggtgttttccccttgctactcgagttttcctagaggaagatcacataccagttaaactctgccgttttgcgtcttagtgcacacgcttgagcccacttgcccaactcctgagatcttatcaggaagctgctgatcatcagcttcggttattttctatctgttgggagactgcctttccctggcaccagctgcaaccaattattattttagagagaaagtttaacaactgcctgaccattacctgatggtcgcctgactttcctgggtgtcagttgtggtggtggggggtcctctcctgccctgctcatgtctgcataactacctactctaacaagaagagagctccagaaggcacaagcccagaggaatcctggttccttgagaacaaacaacagccaattgaaggggccatgaatgaagtggcccattcagagcagtggaaacttttgacttgaagaaagagaacctagtgtcctccttcttccctgtcttcccagctgttgatttgtagtttaagtaagatgctgagaatcaggctttggtgagacctattgttcccgaatgccacccagtgttctgtaattaattctctctgtcctgctttgactactgatgcctgcaagatgccgaggaacgttccagaacattcaccagtagaataacagatattcacatagttttgaggcaagtattgagacctccatgcggggccaggattaggtgaggcgagttaggtactaacctcctcacgaaatttaaagggtgccaaaaaacagctgaggtaatgaaggtaaatactattctaatgtaatgttttacaaatgccaaattaatgcaaaataaaccatgcaaaacatcaaaattttaaattccataataagtatgtagcaccatgcctggcacacagcaagctagtaaatggcaatggtgttttggagcaacagagtttacaggaataaggcaagcctcctgccttccaggggctccctcactggttgggaggatccagcacataggcctccagaactcagagaaacaagagaagtttatatcaagaaaattaggaaaaagaacatttctttgttaaaatgatttttttaactcagccctttgcccagccctaaccacataacaggtgctttcagtgtttgccaaaagaaagaataaaaaggtagaacaaggaggttcatgggtgcggttcaaaggatagtgtccaggcacagttctgagaagtggcagcctggaaaggatgatgcctgggccttctcctacctctctgcaaaggtcacctgctctaccggagctttgtgctatttttttcctttaatttaggaatctaaaaatatatataaaagtagaaagaataatacaataacaccttccatgtattaatcatatttataaatcattattgacattttgctaatcttattttatccattctgcctcttccctgtttaacttttcctgaagtattttaaagccaatcccagatgtcctatcatttcacccaaaaatacttcagtttgtatctctgacagagagagcttttgaaaatgcatagctgcaaaatagttatcacatataataaaattacaagtgatttattaatgtctgctaatgtctgccagagtccacatttctccaaccatctcaaagtgtgttttacaaataactgttcaaatcatgatccacatgtgacctatgctttgcacctggctgatgtgtgtcttaaatctttttaaaatctataatagtccctctcccctttttacctctggaagaaaacctggccatttgccttgtagaattccctacatagtggatgtgattgagcatatccttatagtgtcctttactgggttcgtctaaccttttaatttcctataagctggaaattaggtctacaggcttgattagatttgggttgagtgatctgggcaaaaaaaaagctcatagctggtactggatacttcctattgcatcagaccgggagtacataatgactgttgtcccagcttgtgagttaaggtcactccatataaggtccctctttaacttttcatcctccactggaactttcatcatccagccatgtttgttagctcattcataaaagatagaaaaatttcagctttcatttaagacaggattcctctgagctctgtctagtgctcagacctctagttactcttctttatgtctcactttatgtctacggttagaaatggatggctcacactccaaatacagtctggtgatgtgttttgtttcaacttcacagtattttttttaaacagctgagacaattttctaaaggggcccatgataatgtacatttttaaatatgcattttcagcttcctttgaaataccgaaaatccagcagcattgactcgtggctgacaccctataacagtgtgcactcttggttgtcagtcatcactgccatgcactcctgtagccccccaggctgaggctgagcatcactcatatctcccagggatctgcagtgttgtttttctttggatggagaactagttctaagtgccaaggttaccatcaaaaatctgaaaccaagggatatcctggaagggaagcttgttttaagaaaatcaggaagaacgtttctttgttttgacatttttaaaaatgagaataatagtaaaataaagtgtatctgtgccaaaagaatatgactcgagatgccattatgttactaccagccccctttgctcattaatctctattacatagagtttgcaaccccttttttatcgttctcggtaaaatcatccattcccataacttagataccttcttgggtataaactgaattgtgttcctcccaaatttatattgaaactctaagcccctagtacctcaaaatgtgtctgtatttaaagataggacctttaaacagatgattaagttaaatgaaggctttaatggaggctctagtctaacccaatctttttatctttagagacaagatctcgttctgtcccccagactagagtgcagtggagagatcatcgctcacttcagccttatcatttatgccggaggttgcaaattttttgtgtgaaatatcagaccttggtaatgaccttgagcagtaggatataaataactcccacaagcttagcgtactaggcataagtggattaaactcctgggctcaagtgatcctcctgccttggactcccaagtaactaggagtaaaagcatggcaaattttgtttttatttttctttcttgtagagagggtgtctctctatgttgcccaggcttgactgatgtcattataaggagagattaggatacacagagacactgggacacatgtgcatagaggaacgactatgtgaaaatggcaagagggtggccgtctgtaagccaacgagagaggcctcagaggaaaccaacgctgctgacaccttgatcacggacttccagtctccagaaaggcgagcaaataaatgcctctaagccacctagtctgtggtactttgttatggcagccctagaaaattaatatacgtctctgtgctgaaaatcccagatccaagtccccagtccacagtgctgtgctaaactccagacctgaatgtcccacagcctccattacagctgcaagcaaaaatttcacagggctaagcagagctgcaaaggcaggaattgactatggagggaggatataggtgtggctagattagagagtacagtagtgccccctatccaggagggatatatttctaggcctcccagtggatgcttgaaactgaggctggtatggaaccctatgtatacaaggtttttttcctacacatacatgcctatgatagataataatgtatatattaggcaacaacaataactaataataaaatagaacacttataacaaaatgccagtaccactgctcttgtactttggggccattattcagtaaaataaggtcgacttgaaaacaagcactgcctcactgcaacagtcaatctgatagctggaatggctggtaagtgactaacttagcagagtatatagtgtgggtagagtatatagtgtggaaactctggacaagggggtgattcacttcccgggcagtacagagtgggatggcaaaagatttcattacactactcagaagggtatgcaatttaaaacttaattgtttatttctggaattttccatttaatatttttggaccactgttgccccaggtaactaaaaccagggaaagcagaacctcagatacggggggaactccgtaaagggaaagaagcctgaacaggtaggttgtgatgggattgtaaagcactaagaggcagtaggttttctgaagaccacccaagatttcagagttgcattttggaaagattaatcacgggacggttaccttcccttattaggaacaattaacatgccttaagaatgttttgttgttgtatttcaatcctgaatccctccaaccaaacattgcagaccgcaataaacattcgttgagttccaagtcattccacatcagagcaaaagggcactgcaaggctgaattagcattggccgggttgtgcaaactgcctcaggggagaaggcctgagttttgacctaggtcaggatgagatgtagcacatgattcacagaaggggctggggaaaaagctggaacaacaagggaagattctcccccggagcctttggagacagcatgcccctcccagcactttgatttggggcttctggccttcagaaaactgagacaataagtttctgttgtttacaaccaccaactttgtagcaatttgttgcgggaagctaattcaatagagaaccaaattagaaccacacatatataagtccaattgattttcaacaaagatgcagtgtaattgaatgagaaaataataatcttttcaagcaacatcactggaacacctagatatccaaatgaaacaaaacaaacctcagcctctacccccagagcatacacaacatttatgtgaaataaaccataggcctaaaagctaaatctataaaacttccagaaaataacagaagaaaaagtttttatgaccttgtaggcaaagatttaagacacaaaaagcactgaccataaaagaaaaaaatgatgaattagaattataaaaattcaaaatttcttcaaaagacaccagtaacaaagtaagaaaacaagaagatatatctgacagtttgtgtccaaaatataccaagaaccctcaaaacgcagtaataagaagaccaacaacccaatttaaaaggggaatggcaaaagactaccaaagagacttcaccaaagaaaatatacaaatggccaaaaagtccatgaaaaactgttcagcataattagtcatcaaggaaatgcaaattgaaaccacaatgagataccacttcacacctagaagagtggctaaaattaaaaagttaataccgagggctggcaaggctattactattcttggtgcaaaaattacttttaatggcaaaaacaaaattaagtttgcaccaacctaatagaacactcatgccctaatggcaagagtgtaaaatggtacagacgtttggaaaacaatttagcagttcttacaaagttaaatatatacttaccatataacccagcctttatacttctaagtatttagtcccccacaaaatgaaaacatgcatacacacacaccaaaaaaaaaaatgctcacacaaaaatgtttctaccagctttattcataaaaccccgaaactgaaaacaaccccaagtccatcaacaggtgaatagataaacaaattgtagtatagccctccactggaagactcagtaataaaaaggaatgaattactgatacacacaacatagatcaatctcaaaaacacattaccctgagtgaaagaagccaatcaggaaagggtatgtggctgcattcctaagaagttctaaaacagactcaatccatctgtagtgatggaaatcagatcaatggtagcctgggattgttgatgggagtggaattgactgggaaagtgtgcaagggaaatgtttggggtgccagaaatgcttttatcttgattgagatggtggttatatggtaaattcatttatctaagctcatcagtctgtacactataatttatacacatgtaaatcatacctcataacgttaattaaaaaacacatttcacctctgagttttttgtttctttaaggactgtattagtccattctcatactgctatgaagaaatacctgagactgggtaattcataaaggaaaagaggttttgttttattctgttttgttttgtttttgagatggagtttcaggctgttatccaggctgcagttcagtggtgcaatctcggcttgctgcagcctccgcctcccaggttcaagagattcttgtgcctcagtctcctgagtagctattacaggggtgtgtcaccacgcctggctaattttttgtatttttagtagagatggggtttcaccgtgttggccaggctggtcttgaactcctgacctcaggtgatctgcctgccttggcctcccaaagtgctgggattacaggcatgagccaccatacctggccaagaaaaagatttaatggacttacagttccacatggctggggaggcatcacaatcatggccgaaggggaaggagaaacaaaggcacgtcttacatggtggcagacaagagagcatgtgcagagaaactgccctttataaaaccatcagatgtcgtgagactttctcattaacacaagaacagcatgggaaaaacatgcccctgtgatttaattactttccacctggtccctcccacaacacatggggattatgagagatacaattctagatgagattttttaggtggggatacagccaaaccataggaaggaccaaaactaaaaggaaattttacataatgaatgtctcagatgtcatttattatgaatggaggtaacaaggagtagaaacagtttaaaaagacagatgaggctggaatatgactttgaaggattttgtcagtcctactaagatatttgaaccttatggtagaggcagtaggataacaggcaaattttatgggttccttttaaacattctatctacggtgtcattatatcttcatagggaaatgcatttatttttcaatatacgctatggacactgatgcttacatcttccacacaggaagtatgcaatttatggatatgcagctgggttagcaatccatccaaacaagttctgttcatcggtatgtatggattcaggtgtttcatgtgtgatacctaattttgtttacacaacagcactgaaagacaagcacattatattagcatttcctgcataataagctactccaaaactagtgactttaaataaacaaccacttatatagcttaccatttggcaggtagacagtttgtattgggctcagctaggagatacttctagccttacctgggttcacctttgcctttgtacccagtgctgggttgactggaggctggctgatttagaatggccttccttggaatggttcctttcagttccacgtgtctctcatcctccagcaagccaggccagatttctcgcatggcaactgggcagagttccaagacagacatgtgcaatgcgtctcctagaacctagactcagaaccagcacctatcattccattgaccaaagcaaattaaaaaggaatgggaaatggacatcacttcttgataggaggaactgcaaagcccactgccagtggtgagcatttggggaggagtggaagattgtgaccatttttacaattgactacaattattatctccattttatgtaaagaaaaaccaagattcagagaagttaagtaacttttataaggtcacacagccaatgaattacaatgagctgctgggctttgattccagctcatttctacaagaaaatgtggatcctcattttaaggaacttatggtattttatgctgcttaatccattcttccttccctctataatgttacagaatcaacagatcaggggatgaaggaacagaaagtttatgagcagtagatatttctgaaatgatttcaaatgtgacagattatttcctgagatataaacagaaaagaaattcacttccttttggtggcatcggcggctgaaaatgtccccagcagagattccatttgcccccacatttccttatccttcataagaagggaaacataaaaacgccaagcaggctcttgacccagagctggctgaggatacagcgcacacatccatggttgcatctgcagcgtttgggtgcaaccacaggcagcttcaaagggaaaaggaaggggaaaaaaccttctctccgtagctaggctaccagttcctgtgtagatttctcaagattcaggcaagaggacatgtggagaacacatatttagaaacatcaggtggttgccaaaacaagccaatttagaactgagcgtgacaaatgcacatctgaggttgaatgtcacctggggaacccactgtttctgagatctccacaatggggtggggtgaagcacagtggagaatgtgctcactgagcacccggtcagcctgggtggggtgggcacagcccggttgctacaggacatggggcaaggcatggcatccttggaaatacacacatatacattgacattgacaaaaggaggaagtgacaaggaaagaaatgtggaaaccattagagctgaaaattttgtctctaaatgtgcttatgtggaagagctagacagagttgtttactgttgcctctgcaaatttgaatgggttgattagatccttcttaccaaagtaaatggagtgccacggtgatctccaaacttgcccaactctaggcggcactcagctggaacgtttgtgcacaaaacacctgcgcctgtgtcaggagattctgattctgtaataggtcaggatggggcccaggagtctgtgtttcccaagagctccaggcagctgtgattctcaggcaagcatggatataccagcgtgcagctgtgcagagcttcccagctaaacacacatagaacatctctgggggaggggagtgctctcttcttggtggaaggcaacatactcaaggactggtcagtatcttagcacaattctagtaggtgtgatgttccaaatatgtagctacaatagggtacagtctccagcccctggggtccctgttctgccaggcgtctgccctttgcacagttactacactttgggagagtctggggcactctggggcagcaggataaggctagaggcctccacagacttagggccttggtgatatatcacctaaaaggaagaactccaacattcagtacagctagatgggggcatccctctgaatggcagcactgcctgaaatacattcactgggcaccatttaggaggtttttgaggttatagaaaaagcctgatatttggagtcccaaatctgtgtgttctcacacaggcactagcatgtactatgtgatgccggctctgtggaagcttcagtttccctgtccccaaaggatggagatgatgcgtcttcgttcataaggtcacggtgagtgtctaatagacagtggagccccaagcactttcatcaggtctaaaccagtgtacaagtgttggtttctttcttcccatcatgaaatttaaagacatctcaggtgcctccatgtatacattgtttgggatttttgttttgtttttttccaatctgtgaaatgacttaagagttcacaaacagatccataatcccttatctgaaagtccaaaagcttcaaattccaaaagacttcccatatttggtgggacaatctgacctccctgagtttgtttcccagctaaacctaacatgaggcttttcatggtttgtgtttgtcacctgcttatggttttctccagagatactagtgtgttgggctttggggtgctttccaaactcccctaggggtgttacataatgcaagttatatgcatacattataagatatgaaagtcctgaattctggaataatctggtcccagtggtatcagagaagggaatgtggacctgtcactcccccactaaaagttatggaattattagctttaaagggagtcttgaggatcactgtacgcatgtcaggaatcttctaccgcatctcttatagacatcttctaattgctgtttgaaatcttccagaaccaaggaccttactgcctaagtcccagacactcattccattgtggatcacttcttcaaaggacttccagcatctgcaccactgcaaaataaaaacacggagaaaaatgccattaaaggtactaaaatataaagctgttctcctctctctctctctctctctctccctctctgtcatggaattttttttttacttgctatttaactttgtaagcaaagaaaaattaaaatgttaaatgattagcataaattctgttcatcttgacattgtgcatttccagttttaaatgcaaatagagacatttaacttacatgcggaatcactgatattatgcaatttgtattttgtagcttatatatacatatgtatttgttcttaccagtacagctaagacagaataccaaattagctgaactattttaattcaattgtgtgtgtgtgtgtgtgtgtgtgtgtgtgtgtgtgtgtagagacagggtcttgctgtgttgcctaggctggtctcaaactcctggcctcaagtgttcctcccacctcggcctcccaaagtgctggaattagagacatgagccaccatgcccagccccttcatgtcttgctatgggcacattctacccaaactctaccttcatcttcctgaggagtaaagcaggaccgaaaggaaagggaccatctttccttgtctttctatgccatcatcgtcaccctatatggttggtcaatacagggaaacaacatgaatgagaatggatatgacaagatgccttgattgttcctgtttcttagaacaccactgcctactttgtgctttcaaagcaagttctgatatgaaaagaaaatgtgaccccttgggggtggcagagccccctattcagtcgtagctgtaacacacttaccttgtgctcactttgagtcttaccgatcactgacgcatcgtgggttcatagagcatcttgaacactgtgtcaaggagcagcaagggacagagacacacacgttgcacttccctcctcgggtcacagtcatgctccagtgtcccatcagacttcacttacaaacagattcaaagataaaagtgttaagaatttcaagacagccacagcacagccttaatccaagcactaggccttactgagcaaggggtcctgtggggctgcccaggccactcacccaggaagctgggcctgtggggtctatagaagtgggttgttcctgtcctttctacatttggactacctaactttagggcccctgagggagcccgtatctaagtcacctgagggtcctgagtgggggaagttcatgtgtgcagttgtcagtggctgaaatggctttctgtgttggccttaacaggtgaaaatgtaatgtctggaaatatggctgccattttacgaccatgaggagataagcctaaggactaaagataacatgtcaaaaaaggcagagcagacaggagttggatcctcattattgaaccacaggactaaacaaccctttagctgccttgcctcaagagttcttactatctgagatgataaatgcctttaaagtttaatctacttttggttggctcttctattagcgcaggcaatagcatcaaatcccataacacagacacaaccccacatttgcaggagctgtgccagccttgatgttgcatcccctattctgggaggtgtgtgttcagcaacctgacttagaccgccttcctggtggagaggaaggttgaggtaagtgcctaacccaggtctctaacttatctacctcttttgttcccagggtagtaaccacctcgcccttccagttgcatttcaggcacttcaaccaacctaagatgagcacgatctatgtgccatttgccaagaccgggaaggcaaagaaaacatgggccctgacctcaagttgctcacagccacgctggaaagaaatgttgaccaagattgttattagtgtctaagattcagttctctggaaaggaactgtaatatggggaaccagattcagaatggttactgggtattgctctcgaaggattcaccagtaggaagagaggaagatagaattgggaagagagaagggacccacactgtggtacaactgagacctcagacaatcccatgtgaaactctggagctggggaggcccttcagagttgccccaaattacggtaaatgggctggatcttcatatccctaatcagccagtcatcagccatgggctgcccctgggagacagtataacagcgggtgagacacaggatggttcccagtgaaggactcagggcagggctgggggcaccagggggaggtcgggccacagtccctgtgcgcttacaatggacaaaggaaggcagctctgacatgaatgatgatcgagacttttatttgcattaatgagtgagataaaagtgatattcccagcagggggatgggcgtattgcctgaagagggaaccttgattaggtttcataatattcatatcagttaggttgaccatataatttatccaaactaggacactttcaagagagaaagggagtattattaattacatcagtacaacggtttctgtgcacagttctcattttacagatgaggaaactcaggcacagaaaggttgagaaacaacatcatttgctaacaagtagtagtgaagaggcagggccaggtttcacactctggcagtctcattccagtgactaattctcaagacactgtagaggtagagttggcagacttggcgatggattggctgaggggtgtaaactgggagggccagaagggatcctggcattcaggcttgagcaactgggaagatagtgggactcttgacctgagagggtgtcaaagtagggggaggggagggaggaaaaggggatctcagaccttcagtgagtggcagtgcaatcactctgctggctccttttattttttgagatagggtcttgctctgtcacccaggctgcagtatagtggcacaatcatagctcactgcagcctcaaactcctgggctcaaggatcctcccgcctcagcctccaaagtagctggactacaggcacatgccgccaagcccagcgcatactccatgcccggctaaattttttattttttgtagagactggtctcagtatgttgctcaggctgccccactggcttcagtgtaataagtggaaactgaaagatagctttctcaaattactcatgtttattgtagaattatccaatataaaacaatatcttatctagaatttttcagtctttctaaacaaaagcttcctagtgatgcacccccctgcccccacacaaacacttttttaggatggggtagacagccacagtacctcaccctcaggtgagtatctcaagagcctattggtggcccaatagctatggatgctgtcgcttctcactgcggactgcatttgctataagggctctctcagagcaaggagcttccagccagaggctcaccctctcgcactgggacaggagacacagcatgcagctccgtggtggcaacaagggtgcctgggctatgaaagctcagagttctgctccaagtgggacatttccttctgggattggtcccctagtgacattgctgctcatgcccttatgatcggttacatgcaaacttgcaaaccctcagggttgatcttatatactgtgcgtgtgcacattgactcagctacccccatccatttggctgtgggatttcctgatatgcaaattgggcaacccttagaacaagagctgataaaatgtcatggccagaattgagacttagattcccaaatgatacacttaagcatgttgtagaagggaagctgagaagagaagcaaattcggagagaaagactaaggattcagccctgcatatgactagtttgaggtaccagtgaggcattcaagggaaatgtgtgcccatgagaggttgactttgtagtctgagtgtttagagagatcttggttttctatagaaatcaggggatcataaactggttcatggtcattatctgctgcatggaaagtattggcatggagagtgcctagaacagaactatgagaccctatagcatttgagggctggatacaagaggaggagctggcagaggagtctgaggaagaacagatcagggcagaggggacccaggagaggtgactgtcagaggatgccagggagtgggttttaaggaggaacagtcagtagtataaatgctgtggagaggtgtacaagataaagtctccaaagcacaggccacatttagagagatgcaggtcaccatggcaaggaccaacttcagtgagggggctgggggcaaaagccagaagattggttaaagaatgagcaagaatgggtaataggagttacagagagcaggtaatttgttcaagaagttgcctgtcaatggctggtgtggggtgacaaaaaaaaaaaaaaagccctaatgggtggggcatgatttcaagggagacatttgcagagataagagagctaggcatgttttttgctgatgggaactaataaggagatagaatggggcaggctgaagacacaggagagggaggaagcattgaagaggctgagatccagagaaggaagacattaacggcaagaatgaaccattctctgctccctccatgaactgtgcctttgtgaatgtcttaaattccgcaatctgaagaataggtcaactaaagggacaacgacaaaaccactcagcctgcatcatcagtgagtgccaactatgaaacagacattctcagcgagaaaactgagcacaaagaagagcagacagatagatcgatccatccatctatctgtccatctatctatccatccatccacctcctcagccacccatcaattcatccatccattgatccatccatctattcatctatccatctatgcacccacccatccatctaccccctcaccaccaacccacccatccatccacccgtccatctatttgcatatgaatgaaaatatggtgaaactaagcagcaggaaggacacagacctggaggggttaaagactggaaggatgagtgaggctaactaaggtgtgagtgctgctggcttcactctctgtggtcattaacttgctaatggagtccctacctccattagctgggcgatcagcaagccagatcaatgggaccatggatctactgctctagaggtttccttagagccaaagtccagctgtctagacttgtgatctgcccttgggtcaaatctgtgaagaataggctatgtggggtgtccggaattcagtcaagagctctgatttcttgttgagtcattgctgtgtgatcttaaggatacctgtgcaccttcctaggtttctgtttcctcatttgtaaaatgggagaaatttgggcaggcaatagatgatccccaaagcccttttcagctctgaggttaaaaactattctaacccacttaaaaactgatcaaaggacttaaatagacatttctccaaagaagatatacaaaaggccaacaagcatatgaaaagatgttcaacatgttagtcattagagaaatgcaaatcaacacttcaatgaaatactacttcacacccactaggatgggtatcaaagaaatgaaaaatagcaagtgctgacaaggatgtgaagaaacgggaacccttgtatattgatggtagaaatgtaaaatggtacagccagtgtggaaagcagttgagtgactccccagaaagttaaacatagaattaccatatggcccagcaattttacttctagatatatacccaaaagaactgaaataaattcaattaataaatacttgtgcccaaatagtcacagcaacactattcacaataaccaatgggtgaaaactggccaaatgtccactgatgaacgaataaacaaaatgcagtacatccatacaatggaacagtattcagtcgtaaaaaagaaatgaagcacccatatatgctacaatatggatgaacctcaaaaacattgtgctaagtaaaggaagtcaggtcacaaattatatggctccatttagttgccttttgtttgttgtttgcttgtttgagacagggtctcactatattgcccaggttggcctcaaactcctgggctcaaaccatcctcctgccttagcctcctgaatagctaggattacaggcatgtgccatagtgcacagtaattatatggctgcatttatataaaatatccagaatggttaaatccatagagacagaaagcaggttggtagctgaaaggggctggggagaaaaaggaacagggagtaacttactggacacggagttttcttttcgggtgatgaaaatgttttggaattggataagggtcgtggttgcacaataatgtgaatatactaagttccactaaattgtgggctttaaaatgattaattttatgttaatgtgaattttgccttaaatttttttttttttttgagacagagtctggctctgtcgcccaggctggagtgcagttgcgccttctcggctcactgcaacctccacctcccaggttcaagtgattctcctgcctcagcctcctgagtagctgggattatagggacatggcatcatgcccggctagtttttgtatttttagtagagacagggtttcaccatgttggccaggctggtcttgaacccctgacctcaagagatgtgcctgcctcagcctcccaaagtgctgggattacaggtgtgagccaccaagcccagacaattttttttttttttttaaagaaaaagaagctattctagaatctcttcatgacaaaacaaaacctatgcaactccttcaagtccctgttttggaagtagcctggccactccaggccacctctccctctctcacatctgattaatgggtttggagttcacaacaccagatatcacattccttccttaataaccaagtccaaaggtctctctgccttccctttccccatttccatctcaggatatctttaaccttttttggaagacgcccttccctaagtgagtggaacggagacacttccggagcacctattttgggaattagcccagattgtagacaaacaaccaccatatagggagacattcgtgggcgaaggcattccatggccagaggtgagaggtgagaccacagagctttgaggaaatggacactttaaatgttggccaaggcagccatccaggtttcctgtggtctgagaagtggcggggaagttgatgtcccagcttggtgtagctgcacggacatggatatgggaatcagtcacaccctcgcttcttatcaaacagaggggacccttgagcaaattggttcatgaccagaaggtgctattttcagcttccttttggagtacaaacgttaggctggaaggcagggaaagtggtggaggaataaaaaagaataaactggaaatgggggagatggggagagggctaagcagaaatggtatggctaattcagtgggtgaccttcaacaagtcccttcacttcaaatttaagtcgacctggttgggttaaactagagaaaaggaagaaaatgttaaatgccagtgcagatgagtttgtggttaaacagaagcagtcacgcagttctgttgatgctgaaactgcagtaggccgtgtgaagggacctgctgcaggtcttatgaactgaagggggccagggatcagcgtagtcacagaccgtaacactcatgaggcgtaaaagaggatttcaagacaatatcatgtagtaaaaggcgtgcaagtgtgaaagtctggtaggtctgggcttgaaccactggttttatctgttaaagataaaacacttgcacgccttttactaccttacttgctctatctacaaaatgggacacacatatatatacatacacacacatatatatatacatacatatatacacacatcacacaaacacacccacacacttattaaggttgtggatatgagaataatgcatgtgacctgactagaacatagtcaattttaaatagaatagtgtgcgttattttcctggctcagcccttcaccttctctcaaggtgaatttgtcctagacgccagtcagaccgtgatgagtcacatccctggaggggccacccccttaggcatatcagaaatgtaggatgaacaacatttagccaccttccctagcaacccttctgtacacaccaagagccaaaaaaaaaaaaaaaaaaaaaaaaaaaaaaaaaataccacagctttcctgttcactttacttctgggaatgtatccaaaggaaattactggggaagaaatgaaaaaatcacatatatacagatactccctgacataggattgtttgacttaggatgttttgactttatgatggatttgtcaaggcataaccccatcacaattagaggagcatctgtagctgtttcttaaaaggttatttatcatgcacaacagaaatgtctactaagaagcccaggaaatatggcttgttgatgccatgaaatactgttaggttagtgtaaaagtaattgtggttttgccatggaaagtaatggtgaaaactgcaattacttttgcgccaaactaatatacatttacaatgatcaatgtgataactgtagaaagatgaaagcatgtaaatgtcaagtttttaaaagttggccacaaaactacatgtacactaagatattaactatccagcttatagctaaagagtgcaaggagctgtggagaaatgtaaacagttgatgcactggaggaatagcattatgggtacagtatttttggcatgataaaactgtttaataataaataataaatatctttcctatctcttttaatgacatgaagtagatgatttctaagactttattcctcctgaggactctataggtaatttgcttctctttatttcaacttatgcttcctcctctgtaagattacctggtagttttctagccacaattcttagatttgttatctagagccacataacaaatgacccccaaatttagcagcttaaaacaagcatcggttgtctcatacagtctcaagcattgggaattgaggggaggctgagctcggtggttctgctcagggtctctcacgagggtgctgtcaagctcttggctggggctgcagtcatttgaaggctcaactggggctggagagtccattttcaagctcaccacatactggcagaagtcctcagttccttgtcatggggtatctccttagagctgctcacagcgtggcagctggcttccctcaaagtgaatggcttgagagagagcccaagaccaaagctgaagtcttctataacctaatcttggaagtcacatcccagcagatagtgagttattgttactgctactgctatgttgcaacagcatccattttgaatataagctgaactttctttttttttttttttttgagacggagtcttgctctgtcgcccaggctggatggagtgcagtagctcaatcttggctcgctgcaagctccgcctcctgggttcacaccattcgcctgcctcagcctcccaagtagctgggactacaggtgccactgaaatttcttataccagaagtagggtttggtcaccctcaacacactttccagttctctaccctccagttcctcaatgtggtcattccagatacctgccttaccaaccacctcctggtgaacacctccccatggacagccggatacaacctacttgatgcaccccactgattcccataccccacatggagagcacagatatgctgcagtgactaccctctcaatcacagtataactccatgaaaactgcctgtttcctctaaacccaccaattagaacttcccaggaggaaacctgcttgggtaatgccctggatccaataatagctagggcccacagacccaagtgggtgggtggggagccttatagctctctcttactccccacccactgtttgaaagcattattctggatggcttcctgcttcccattggccctgcgaggcatgctgccttcttctctctgggatctgtgagtaataaactgcttctgtcatttcatgtgttttgctatgtcatctcctctaagtctcatccaactaacacacccaaacccagcttctttccatcagggatcttccagagaatggatgtcttggtaggaataaactggacagaggtcagacaagagccacaagggtgtctgccagtgtaaacaaattttcagggagagggacacctggtcatgggtctagcacttaggcattaggttgtctgccagaatagagacatatcccatggaaggcacactataaatatccatggccagatccctgaagccacatcacagcaggggtagagtttacagccactctcatgagagggacctcaagacctaacagaggaaaacacaacacacacttctaccatgtgctattggtcacagagaacactcctggaacaatacagataggggattacacagctgtgagcaccagaaggtgggggtcactggaggccgtgtgtgggctgccacgtcacaccacaaagtcatacttctatcctgcatgaatggcagcttgttcctctactcctcccatagactggtggcctgttggacatcacattatccaccacactgtactaagtaggtgcccaagagagccttattgatcaagtgtatgtttttctgcatgcattcaaggcatgtgagtattagagacagtgtctagaatgtgtctgcctcaccagatgcaccccatgaaaaggcagatacactgctgtccccgcttcttactcaatgtacccaaggttattagctgatccataggagagcttagattcaaacccaggtggatctgtttgactcttaagcccatgcttttcccactctacagggctagtttccagataaaaccctccctctttcaggcaggaattaggagctgtctgttagctctcactgattcctacgtgcctgactaccactctacctattgcccattatgtgctggtaaatgtttaacaaccagctctctggggaaaaagaagtcctggtctgtagcacttgctgattgccatggtgtaaatattcccaccatggccacttgcaaactaccaacctgatgtccttgatcagagagttggaaagagagacatgatctgccattgtaagcccataagagccacctccagcccaccactgtccactctggaagtatatgaaacttctggaaaaagacatagaacgatccccaaacccattctgaactgttaacatgtttttgcctctctagttgttgctgctctgcctcgtcccgtgttagccatctggtccatgacgtgcacacagaatttgaagcctaccgtcaacctgtcccccacccccaccaagcctagttcaactctacagctctggcccagggcttgtgtatatggggcttagaaatacagacctattcctcaacccctctcatagtctgccctagatgagacctcctgtatcccagcgaccccccacctgactccttttatattgccagctgcctaaaactcagtgggggtggctaaggctctacctagaccaccatcaccaagccttcatttgtgggaggttgaggaggcatacattattagacatcctagtatcagggcagtcaagagcacacacatcacacacagatgcactccagaagaatgtacgaagctgactgtgcttcaccactgtgtgaatcatatcatctgacccacaaaattccccgaccccacaggaacatggggttgggatttaggagtagctttttcaccctattcaactcacctccctctagctccttaatttacacaagcctcctcatattgctactggggacaacttcaccaggccacccactgcagacattgaatgagccccatctcccttctctttaccctctatcctcattgccctaggtccttcctctgaacctctggtcactcttagtgccatctggtttcaggctcaaggaagaacccccaggacctgctggtggaacactgaaagaaacccagactttgtgagatgtctgcaggggcctcctatgagtgtcatgtgctctttgactgcaagagtctgtgagtccattttctgggtcatgttcctgaatgtcccatcttagctgtgcaacagatctcgacaagtgggtggagttgggggaagccagccagcacccaacccaccactcacaacctgggcagattcttctgcatcccagcagctcccaagaatgcttatctccttctgagacctaacagaaggatgatgaagctcaccttgaaggcacagtccagtttcctacttgaggaaaaatcctgaatcattttgtatcttgagttttcatgttctgtttttttcctgccgctttttcttttccctctaagctttatgaaaagaatttctcttgtagaaattcttataaggaaatgaagaggttattgacttcaagataaagcttactggaagccctttgatatttcatttaggaaacccttcactgtctgatattctagacctctgaaaactctattgtgggaagacttgttggaccttggaataagtcagcttccctaaggatggttgcttcccccacagtctcttttcagacaacgtcatccactcatgcccttgtcatcttggagaggattgtcattgttctccttatctgcaattttatgtaaaactctcaggagtggaagtgagtgcccacagggtgagcatcccaggacatccgcaagcagagttttggaaacaacagtctaaacaaattagagcatcatcgtctagacttaggcaggcttagggaaactgaccaagcctgagcagaggatagaggacagactagtggaggaaggcggatgtcctggggagggtgagacagacaagagggtggagggggaataaccaaggtgggaagtccacgtccctagccagagcccagatggactccttgctattttaaaatgtgcctgggatcttgttataatgatggttagttgacagatgtggagatgacggccttgcaaggagagttcaatatttctatttctatttcctaagaggaagggatccgccacaccatgcagggccatgtcaggaagcaccagtgctggtcaggaggcaggaggagcgaggggcaagcatgaccagaccctgaatcgtggcttttgtggaaaggaatggtccaaacatggtaaatattctaagtaagctgaggactgaatggttggaataatttcagtgggctctgatctacgggtgtgatccccagttgtctagtatctggccctgagatgatttagggtaccgggaatattggcttggtatgtaagggtctggtaaaagagatggttgggttgtgggctctggactggttgtttgtatatcaaaggtgtgctggcaggcaagttgtctgttatctccaggaattagctaaacctggaaggggcagactctcccagatctgcaaggccccaagacatcaacgcatcataaaatacagaaaataacaagcaagattaatgcactcatcctggcagaagccaggctgatctgaggcttctggactcaggcagactggggttcgaatactggctcttctctcatcggttggcgtgaccgcaggaagctactgaatctctgtgaggatcagctttgtctactgtgtagtagtaacactgctatcccactgcagtgggtgagtcctaggcatggtgtctgacacgcagcgggcactagagaaatggtaactgccactatgattctgggtgagggatatctcacgtggaaggtttgtatttatctccataatgtttccccttgttaaaattgacagtattgcttgtcatggcaaacaccagaaacaacctagatgcttgtcaacagagatttattaagtaaattatgaaaccatccatatgtgggaggttaggcagtataaatagttgaggaaatgcaatcacaaatgccatatatgctttgttattgagtaaaaaggacaggttacagaatctaaaatgtcatatcatcccgtttaaatgtatacacacacgctcacatggaatattgtctggaaggatagataacaaatgattagaggtgattctttgtgaggagtgggaaatgactgaagggcagaaaactttcctgtttttatttatcattctatttgaatttttacaaataaaatatgttgtttacataaaatcataaaaaaaatccccatttcggagaataaaagtcaagttgtttgaaagagtgtcgtctttcagccagcccccatctgagtccttggttgaagacggagatttgccaaagtggatagaaactgccacatggtgtcacaggggattaggtctccactggccacccaggcaggtgggtctcactggtgggagcagcagctgggggcagactgggtgcgctcagtgttcagggattctggccctccctgcccggccagcctgagtcacctgtgacattgtggcatatttttattgtatttacatggcaaaaattctttgtaatgatatgtacatttcccagctctgcattcaggaatgtccatcagtaattggccataggagaatttacaccacaggaatcagcaaatactacaaataaaagcttgatttgttattttgttgattgtctactattaaaaataatgggtaagtgttaacgatgcagattcaacttaaaagagtgctgtgtctgtacttgttatattgtgaattgtacaaaaaagaaaaagagaaaatattcctccaatattcaaaacccattttataatccagcaaaaaagtaatttatgccattgataaacgagtgaagttctggcacgtgtcttccttgtttcactttcatcttactcattaacagaaatgaaaataactattgttcatggcaggactgtattcctttgtcattcacaactgtagattgactatggcctgaaaaaagctttctgtaagaatctattgttataaagctggaggcatcaggttatctgacttcaaactataccacaagcctacagtaaacaaaacagcatggtactaatacaaaaacagacacatgaacccagaaaaaaaagccacacacctacaaccatctgatcttcaaaaaagccagcaaaagcaagcaatggaaaaaggactccctatttaataaatggtgctgggataactggctagccatgtgcagaagattaaatctggaccctttccttataccatacacaaaaatcaactcaaagtggatttaagatttaaatgtaaaacataaaactatataaaccctggaaaataacttaggaaataccattctagacataagccccggcaaatatttcataataaagatgccaaaagcaattgcaacaaaaacaaaaattggaaaatgtgacataattaaactaaagagcttctgcacggcaaaaggaactatcaacagaataaacaaccaacctacagaaagggagaaaatatttgcaaactatgcatccaacaaagtctaacattcaggatttataaggcacttaaataaattaacaagtgaaaaacaaccccattaaaaagcgggcaaaggacatgaacagacagttttcaaaagaagacatatgcatgaccaacaagcatatgaaaaaatgctcaatgtcgctgatcattagagaaattcaattcaaaaccacaatgagataccatctcccaccagtcagaatggctattatttaaaaaagtcaaaaaacaacagatgctggtgaggtttcagagaaaaaggaatgcttttacactgctggtgggaatgtaaattagttcagcccttgtggaaagcagtgtggtcacttttcaaaaaaacttaaaacagaattaccttttgacccagctatcccattattgggtatatatccaaaagaatagaaatcattctgccataaagacccatgcacgtttatgctcgttgcagcacttttcacaatagcaaacacatgaaatcaacctaagtgcccctcgacagtatactggataaagaaaatgtagtacacatataccacagaatactatgcagtcataaaaaagaatgacatcatgtactttgcaacaacatggatggagctggaggccattatcctaagcaaactaaggcaggaacagaaaaccaaatatcgcatgttctcacatacaagtgggagctaaacattgagttcacatggacacagagaaagaagtaacaaacattagggcttacttgagggtggaggtgagaggaggaagaggaaaaactacctgccaggtactatgttaattatctgggtgataaaataacctgtaccccaacctcccatgacatgcaatttaccatataacaaacctgtacatgtaccccgaacctaaaataaaagttaaaataaataaataacaacataaaagaatctattattattacggaatttacattagagtcctgcatatttttaattatttgtcaattgtgtcctacacattctttgtatcgctagatatataacaaacttatgtacatgtataattacgcatactttttgtggattactgattattaaatatttaccagcacagcactgctcagactccattcttggtgataattgatcagccatggcattggtattttttaaatctatcagctgctaccagcatggagaggagctgagaatcactaccctagaagaaggtagcaaagaagaggaaactactagcctctggccaaacatgagaccccctgctcccacaggtacagctcagattctgagcactttggggttagagagagggcggcaggttttagggagagtagccccttattaaataagtctggcctgtgggttctactcactctaacacagtggatcacaaggacctccccctggactgagagctccttaagggacagggctatcttacttatccctgaagacctggcacatggtggatgcttcttgaatgttgagaaaatgaattaataagttgtattaagacatagttattccaaacatccaataataatgctttggataaatcaattatggtaccaaattcaaaggattactctgcaaccattaaaaatgatatttagtgagatatgaaaatgcttatgacatactgtaattgcaaacagaaagctacaaaataacatatgaattacgagcacagtttcgttttacaagaaacacacaaaatttattcccgagtttgacagggtataaaatcaacttctggcctgtgtatgattcatgttggagaaacaaatgcttcctgactctttggaatttactgaaacctcattctccaagggaagaatttgtttagttcgtgattattttcatagccatggtatggactagaaagtgggtgctgggatttggagtaatattttgccacagagaataaaagagtcctccctaaaggcggccccatgccctgtggtacattcagataggacatctcaccaatttagatgtttagatatgacatccacatgttgtattagaacatacagaaatatgattctgatattgagggggttagggctcatctgtgattaatcttttaaatttttgatcttttgaatcgttaaatgtaatcttttagtttacataacattgattgcccacagctaaaaggttgggaagcacagtgaccatcatcccagagttaggaagactgaaaggaaagctaaactagctccttgaaaagtcatgtaaactatgtggaattcctcctggatgcatccagaaactactggctgggactgagcaaagataacagctatttaacatgcttagcaacactctggaactcaaatacactttaccaaataaatcactcaccattgttctaggcctggggctcccctggcattgcaggacaaacatgactgtgttcccctgccaagaatgagaaagcacagccagccagctccctctggagcagggcatgaattggcggtggatgaaattggtcttagctcattcctcaagaccttccccgcccagtcactcagtgtgtggaagtggaaagtgtttaacaaacagggtagaattaacttccaaaacagaggtaaaaactcccaggccacccctaccctgcatcctgtggtgtacaactacaggaactcaacaagggcaaaacaccaccaagaactcaaagacgcaagtaagagttaagtctgacctcacatgtcccccagcatgcagcaactcaagcaaacacatccactaaatctgaaaaaatatatttgagagaatgcttacccttcccggtgaccccagaacatgtgagccctttacaatgttgagaaagaaatgtgccttcaggccagttttaccatctaggtaatttcgttttgcattttaaacatttactttgttgactttctgtcttaatgacctgtctagtgctgtcagtgaagtattgaagtctcccacattattatgttgccatctatctcatttcttaggtccagtagtaattgttttatgaatttgggagttctggtgttttacatatacacacacacacacacacacacacacacacacacacgtatagctacaaaatatatatgtatatgtgtatagctacatatacatatatgtgtatgtgtgtgtatatatatatgtatatatatatatatatatatatatatatatatgcctgtgatattttcctgttggactattccttttatcattatacaatgtccttctttgtcttttttcactgttgctgcttaaaagtcagttttgtctgatataggaatagctacttctactctcttttggcttctatttgcgtggaatatcttttgtcaccccttaagcttatgtgagtccttatgtgttgggtgagtatcttgaagacagcagatacttggttggtggatttttatcccttcagccattccataccttttaagtggagcatttaggccatttacattcaatgttagtattgagatgtgaggtactgttctatccattatgttagttgttgccttaataccttgtggttatttccattgtattattgttttataggccctgtgagatttatgctttaagtaggttctattttggtgtatgtcaaggttttgtttcaagatttagaactccttttagcatttcttatagtgctggcttagttgggcaaattctctcagcatttgtttgtctgaaaaagactatctctccttcatttataaagcttagtttcactggatacaaaatccttgacacacaattattttgtttcaggaggttgaagatgggacctccatcccttctggcttataaggtttctgctgagaagtctgttgttaatctgatatgttttcctatagattatctgatgcttttgtctcaaagctcttaagattctttccttcatcttgactttagataacctgatgactatgtgcctaggtgattatctttctatgatgaattttccaggtgttctttgagcttcttgtatttggaggtctaaatctctagcaaggccagggaagttttcctcaattattccttcaagtaagttttccaaacttttagattttgattcttcctcaggaacgccaagtattcttagatttggccattgaacatcccaaatttcttagaagctttgttcgtttttaaattctttttttctttgtctttttctgattgggttaatttgaaagccttgtcttcaagctgtaaagttcttctacttgctctagtctattgctgaaactttccactgcattttgtatttctctaagtgtgtctttcatttccacaagttgtgattgtttttttctttacatctatttctctggagaatttttcatccatatcctgtatttttttttaaagttccttaagttggttttcacctttctctggtatctccttgagtagctttaataatcaaccttctgaattctttatctggccattcagagatttcttcttggtttggatccattgctgaagagctgatgtgatcttttgggaatattatagaaccctgtttcgtcatagtactagaattacttttctgattccttctcattattattgctcttctgggtctagccacccagtggggataccaggctctgagcttgtgctggaagatgtctgcagagtcctatgatgtgacctgtcttcaggtcttccagccgtggataccagtgcccactctgtgagagtctttggttgtagatatgtttagtgtgctgactttcttgaatgccggttatgctagtgatgaggtttcatgtggacacccgcaggacctctggttagccaagatattgcaggcagcaaaattaggtgttgtattctccttcctgggatcaaggtcattctgtcctgagttgttgtaatgacctgagttggttggcctccagccaggaggtgctgctttcaggagagcaacagctgctgtagtagtaggaggctctaagctctctaggcttgcccaaagatggccagggtaagtattttgatttatcaggcaatggatagggccttaaagcttccaagagtttctgggttttgtgtttggctacgagggcaagtagggaaataccatcaggtccaggcagggttaggcaggtctaggctcacactcttcttgtggagggcttaccatggccactgtggggaataggggagtgtctctcaggccaatggggttaggtccagaggggattatgactgcctctgccatgtcatgtagtttgccagggaagtgggggatagttggtagcgagaggcctcacccagctcccacgtagttggaaagactagtcttgctcttgcagtgccccactcagaccttgccccaggccatgagctaccccactgagaaagcaagcacagctctcagaccttgcccctcgcccctcccatctgcccactctgacagtggcagctcctgtgcttctgtgctccctcactcactcatatccagctcttgctcatcccctggactccactcaagaaaatgtgtgcccagtcgaaaccacaaccaatttcagttgggagtttcctttgtcccacaacccctccccagttccactggctgccttccccaagggcccctgtgagatataaaagcaatggcttcccagggctcgagctggagactgagagtgcattaaggctcttcccttgaagctaactgtacttttatatttcttgcacctccctaaatctgtttcatttctaggtaaggttaaatccttctcctgtgatctggattttcagattctccagtggggatgtgtgttcagaggtggattttccccctctcacactttgggaactcacagtttttcacctgtttcatggaatttgcatcagggtgccgcttctttcaaaggatctgtggattcttttggttttcctggtacgttcctacaatggttcttggagcaaaagatcatggtgtgagtctccacacactgttctgttcatccatgtgggagctgcatgttagccctgtctcctatccaccatttctatccttaaacatcattaactgagtggttactatatgccaggtacatagtacaacacagacggttcaggtacaaaaatcagaggcaatttctttcttctaggaaattttagttcagaaagagagataggtaaaaataaccactgaatttcaaacaaagttaaccaagtaaccatcatcactccatcatcatcacatctgctagcattgatggagagcctgttactctggtgctagagtactctacatgtatcacctcatttaattcccacaatgacttatgaggaagttcccattattgattccagtttacagatgagaaaacagagactaagtaattgccccaacatcttaaagccagcatgtgccagacccagtataaaacttgagtctgcctccagagtttctttttttttacattattatttctattatttatatttctattatttctaattatttctaatttctattatttctaataatttctaattatttctattatttctattattttacattaaaatgggatatgagcagactcccatggggcggtgacgggcagagcaattccgagaaagaaatcaaggaaggctttatggaggaggaggcactgaggcagagctttgaatgatgagttgaattccaaaaggtgaggaagaagggtaatggcatcttacacggtagaagctgctgggggctggagcctcgggtgccctgcaagagtaacccaaaagtttgaccagtgctacaataaatcaattttatttaacactcaatggctacttgattattggtcttcaaaggaggcctctcctgcatgttctcacttgttatgtaactcctacaactcgtcaaaacataatctcaaattcctctttagtaattggaaagtaccagccaggcacggtggctcacgtctgtaatcccagcactttgagatgttgaggcaggtggatcacgaggtcaggagttcgagaccagcctggccaacatggtgaaaccccatctctactaaaaatacaaaaattagctgggtgtggccgtgcatacctataatcccagctactcggaaggctgaggcaggagaatcacttgaaccaggaagtcggaggttgcagtgagccgagatcgcaccactgcactccagcttggtaacagagtgagaaattggagaataccatattgtatgtgatggcctcgatggtgttacactgcttctctttcactgcccatttttatttgaaacattaccagacaccagaggctgacacatcaggagagtgcttttgcctcgtgaaagctgccagataacaggctcaaaatgtagcactttcaaagtgccagcaaagacgcttggggacactaagatgtggcttgccttgcttgggggcaggctgagagaaaacgccctgctcactggcctccccccttgtccaccacgtgtcgcttggcaagggagccttcgtggacacttagatcatgctgcttggtgaaggtgaagctggggaagcaggcaggagtggatcccggagggcccggaaagccgcgctgtggagtttggccttgccctgcagacgatgggcagccgttgcccgtttttgaagagaagggtattatgatccaaagtatgtttcaggaagagaactctggctgtagtctaaagaagctttaacatccctctctccacaactgatgaaacaacttgacaacaacattaacgactttgaaacaaagttgagtaagatgtagatgagctaacagtatcaatcaccatgctcaacagctgaaggctctatctttcagtggacaatgtctgtttacctgatgctgggtcataaactaagtctcagtaagtttacaaagatttaaatcatgcagagtggaagtaaatggaaataaattaaaaatcaatgataaaactgtatctagaaattcaacaagtatttgcacattaagcaacaaacttctaaataacccagaggtcaaagcagaaatcacaaaggaaattggaaaatatttaaagcagagagaaaaatctgtgcaataaagctaatacagcgcttggagataatgtatagctttaagtacttacactagaaaagaaggaaggtctaaagttaatagtctaagtttctacagtaagaaattagaaacagaaaagcaaagtaaaatcaaaggaaatagaagaaagaaggtaataaagataacagcagaaataataaaatagaaacagaaatactacaaagaaaaataacaaatccaaaagtttattctgtgaaaagatacaagaaaaaaataataaacacctaactagactgaccaaagaaaaaaataaatacaaactaccagtagcagaaataaaagaagggtttttctgcagacataaccagacagtgtaactctaatatcaaacctaacaaagatattacacaaaaagaaattacagataaatatgccatatgaatataggcacaaaaatcttaataaaatgacaacataccaaatccagtactgtatcaaaagtataatgcatcgtgactaagttggttttattacagaagtacaaaattgatttaacctttaaaaatcaaatcgtatatattgccatattaataagataaaagagaaaaacacatgataattttaataaatacaaaaaagataccaaaaaagcatttgacaaaattaaatgcacattcataataaaattatcagaaaagtttgaggaaaggacatttattaaaaatactacagccggacgggtgaggttgctcatgcctgtaatcccagcactttgggaggccgaggtgggcagatcacctgaggtcaggaatttgagaccagcctggccaacatggtgaaaccccacctctactaaaaacacaaaagttaactgggcatggtttcgggtgcctgtaatcctagctactggggaggctgaggcaggagaatcacttgaatctgggaggcagaggttgcagtgggccgagatggcaccactgcgttccagcctgggcgacaagagcaaaactctgcctcaaaaaaaaaaaaaaataaataaaatactacggccaaatcatacttaatggtgaagtagttaatatttttatctaaagaccaggagtaaggcaacatatatgctatcatctcttctactgaatcctgcactggaggttgtaaccatataataagcaagtaacaatcaaaagacacaaaggtaggaaggaaataaatacagcatttttgcagatgacatcattgtttacatagaaaatgttaagctacaaaacaactactagaattataaaatgaatctagcaaggtcacaaaatacagggcaaatataccttaaaaaatcaatcaattttttttttttcttgagatggagttttgctctgttgcccagcctggagtgcagtggcatgatctcggctcactgtaacctccccgtcctgggttcaggcaattctcccacctcagccctcaactagctgagattacaggcatgcattaccatgcccagctaatttttgtatttttagtagagacggtgtttcaccatgttggccaggctggtcttgaactcctgacctcagatgatccgcctgccttggcctcccaaagcgctgggattacagatatgagccaccaggcccggcctcaaatttttatatattagcagcaaacaatttgaaatttaaatttaaaaagtaatgttatttatcacaatatcaaaaccacaaatatttataaataaatgtttctttaaaaaaatgggcgagatctatacactgaaggctaaaaagcgttgctgtaaacgagagaagacttagagacagagctagacgattgttcatgaatgtcaagactcaagttttgtagatgtcagttttcttttaagtgatgtatggatctaatgcaatcccaataaaatcagttacaagcagactttttttttttacagaaatttgaccatgtagttctgaaattgaattgaaagaccaagaacctagaatatctaaagcaatcttaagaagagagaacaaagttggaggacttacactatctgacttcagacttcaagatttactctaaagctatattcattaagagaatgtgatactgacccaaggcttgacaaacagatcaagaaaacagaatagacagcccagaaataaatccacacttacatggctatttgatttttgataaagtgccgatataatccaatggggaaagaaaagtcttttcaatgaattgtggaacaatcggatagtgatatggaggacaaaatgaacctagacctctgctccataccaataagcaaagctaatttaagataaatggtaagcataaaggctaaaataaaactctaaaagaaaataggaaaatatcctcatgatttagggtaggcatgaattttctacacaggacacagcgacaagcataaacttttttttaattgaaaaatcagaatttatcaaaatcaaagcctctgtgcaccagaagacattgactaaaaataaataactggccaggcacagtggctcactcctgtaatcccagcactttgggaggccaaggcgggtggatcacgaggtcaggagttcgagaccagcctgaccaacatggtgaaaccccgtctctattaaaaatacaaaaattagccaggtgtggaggcgggcacctgtaatcccagctactcaggaggctgaggcaggagaaccatttgaacctgggaagcggaggttgcagtgagccgagattgtgccactgcactccagcctaggtgacagagcaagactctgtctcaaaaaaataaaaaaaagaaaaagaaaaaaaagaaaaaaaaaaaagaataacccagccaaagcctggaagaaaatatttttacaacatatatctgatgaagcactggaacccaggatatattttaaaacttctatacctcaataacaaaaagacaataccacaaaaatttagcaaaagatttaaacaaagacatttcacaaaagaagatatacaaatggctgataagcatatgacaaagtattcaacattatttgtcatcagtaaaatgtgaattaaaaccacaattacataccattcatagtcctcaaggagctaaaatttacaagtctgacaataccaaatgttggcaaacatggaacatccaggattcttgtatacttaagcagtatacattcacactctataaactattactgtattcgcacatgcaacttcttatgaagtgcagcatatgcttaccttataattgggatttctgctcctaggtatttacccaggaaaaaaatgaaagcatatatcacaaaacttctgcgtaagaatgttttctgtagttttacttaaaatatccgcaaactaaggccgggtgcagtggcttatgcctgtaatcccaccactctgggaggccgaggcgggcagatcacttgacacctggagtttgagaccagcatggccaacatggagaaaccctgtctgtactaaaaatacaagaattagccaggcgtggtggcacacgcctgtaaacccagctacttgagaggctgaggcgagaggatcgcttggacttgggaggcagagtttgcagtgagccaagtttgtgccactgcactccagcctgggtgacagaacgagaccctgtctcaaaataaaataaaatataaaatatccccaaactagaaacaacccaaatgaacatcaacaggcaaatagataaataagtgtagtattttattacaatgggatattgctcagcagtagaaataaccaatatacacaacactgtggaaaattctcgtagacatattgaacaaaagaagccacacacaaaagaccacacaatgcctgattcattttacatgaagtttgaggacaggccaaactaatctatggtagtataaatcagaaagtggttgcctttgagaagctgggtgcggtggctcacgcctgtaatcccagcactttgggaggttgaggcgggcggatcacctgaggtcagttcaagaccagcctggctaacatggcaaaaccctatctctactaaacaaacaaacaaacaaacaaaaagctgagtgtggctgtggtggcaaccacctgtaatcccagctacttggaggctgagacaggagaatcacttgaatccaggaggcagaggatgcaataagctgagatcatgccactgcactccagcctgggtgacgacaaaactctgtcagaaagaaagaaagagaaagagagaaagagagagagagggagaagaaggaaggaagaaaggaaggaaggagaaagaaagataaagaaagaaagaaagaaagaaagaaagaaagaaagaaagaaagaaagaaagaaagaaagaaagaaagaaaaagaaagaaaggaaggaagaaaaagaaggaaggaaggaaggaaagaaaaaggaaggaaggaaggaagaaggaaggaaagaaaggaaagaaagaaagaaagaaagaaagaaaaatgattgcctttgagaggtgaaggttgactaaaagcggccatgagggaaatttgtggaaatgaaagtatgcgttctcttgattggaagttggttttatatatatacatatttgttaagatccaccagattgtacatttaggatctgtgcattttgtgggatgaaaattttacctcaatttaaaaagaattgcatatataaataaatataaaaatgagaaaggaaatttatacagagaataaaataattgaacggttaagcagaaaaagtaaagaaaataaatattagaaaggcatagcttctcccaggcatatgggcccatgctgcagagcatggcttggaggattgaaagcgagcttgattttagcttaattcgttcctggctagacacccttgggcagggcgccacctgcacgattctacaaagcacttgtgcccagctccctcctcaagtggaaggacaaggatgcacaaactagtatatgaaaagcccagttcctaggctggttagagcactaggatgggaatgtggagacctgggctctttttatggcattgccataaactccctgcatgtccccaggtaggtatgttccatctctcagctcatttttgtcatccctacatcagcaaccttgtgcctgtgggaggtctgtggctggggaaaaaaatgggtgctggagcttctaggttattggctctaatttcgtccttggagggagtgtggcattgaggcccaagagccatcttttggaccagcatcacaggtgaccctagggtagttactctaagtcagacttgcagattcccaagttgcccctcccagtttcaaaattctgtgatttcaccttctgctaagtgtaaaagagcattttcttgaggagtccacgtagatgagaaggcagccctggcagtgggcttaatgtgcatacagacagatccctggagaacagctgcctgtctggaggcaatgatagcagagacataatgaccttagcctccgaaaggcagctgcagaatcctatcctttgcagggctaatcacttttgggacttatacttcctggattgcagtgggcagtggcccaggatgcaggtcagatagctgagaactatgtggcaggttcattagctggaaaacctccccaccccaactaatcaattgtgcaaggcctgaaacctgggaatgagggaagccagccacctgcagcacaccacaacccctttcctgggtaggtaatagctggttcatgcagaaatgagttgtattagcacaaagagtggatcccaagaagaaaccaggagtttgatggaaaaaactaactctattcctgttcactgttcatatatacatatatatatacacatatatatttgttttgttttgttttgttttgttctgtttgagatgcagtctctcactgtcgccctggctggagtgcaatggcgtgaccttggcttactgcaaccaccgcctcccaagttcatgcatttctcctgcctcagcctcccgaatagctgggattacaggtgcacaccaccacactcggctaatttgtcgtatttttagtagagacggggtttcactatgttggccagactagtcttgaactcctgacctcatgatctgcccacctcagcctcccaaagtgctgggattacaggcgtcagccaccgcgcctggccattcacttaaatatttacggttgcacaaacaatcttagtactgccctaatcatccagtctcctaggggtacacggaggctttaaaaaactacattttgaaatatggcattgttgagaaaactatttcaagtcccacaccgaagagttaaatgaagctcggttttgagatgggagcagcctgtccagcaggagggccataggtgacagagaaaaaggcttgtggcccagtttggggagaattggtttctgctgggctttgacatggaatttgactcaagaagaagggagttggagtctttccaaacataaagcacagccaaggatgaggatgaacagaggtagaagggctctggaaggcgtctggtagaccctgaggttggtagcccatcatttcatcccagtgatgaacctgaccattagcacatggcattcccctggtgacgatgatctgctaaggggtgcacacgtcccctaaattggcccagtcagattcaagaaaaacttgacaagacttagaaaagaggtttctccatcttctccttgtgggtgtggataaggcctttgggaggccaaggcgggcggatcacttgaggcctggagttcaagaccagcctgaccaacatggccaaaccctgtctctactaaaaatacaaaattagtcgggtatggtggcacaagactgtaaacccaactactcgggaggctgaggtgagaggatcgcctgaacctgggaggtgaataaggaagcatattgaccttgtggtcactggctgccaccccacaaccacgagatggaccagcctcagggtgacgtcagtgctgagaatggaagagcaagagactggaaaggacgtgttccctgatgccagcatcaaaccacagggtgtcctgtacctgaaggcccccctggctctgcactgcgagctatgtgagatgcatttctttattgtttagcccccctttttttgagacagagtcttgctctgttgcccacgctagagtgcagtggtgcgatctcagctcactgcagcctctgcctcccgggttcaagcgattctcctgcctcagcctcttgagtagctgggattacaggtgcctgccaccataccaggctaatttttgtatttttagtagagacaggggtttcgccatcttggccaggctggtcttgaactcctgacctcatgatccacccgcatcagcctcccaaactcctggaattacaggcgtgagctactgcaccctgtttagcccctttttaatcagatgtcttttctttgctgcaaaagcctcttggctggtacaacatcctgcagaagaagttgcacatggaaatgtggacaggagcctcacagagaatcctaatgagtaaggcaggctagtgtgtaggaacctatcacgtttgtttcaaacatttacaaaatgtcagttttgatggtgttttttctgcaaagacacacttgatttgcatattaagtattaggaatatgcttccattccaccaagaaaaatgttctcacccatgttttgtaaaacctaaagctctctcagtgttcattttctatttttgaaaaaaagtataggtaggagaaatatctcacgtttgtctttaaggaaaaaaaattcagcgtaggtgcaacggcaaattgttagagccacgtggcctccatgtgaaggagacaatagagagtggtggggactggggcaaaacggagagctcatggcccatctaaagggcttcagcagctggcgacatgtaggactgtgggcctagggtcacctgtgtctactaaaaatacaaaaattagccgggcatggtggcataggcctgtaaacccgactgctcgggattcttcaacagaagctataacatcaaatttgtatgtgaattctccagactttcccattttaaaaagagtaaatcaacactgtgtgagccaaacatcataaatctgaagttgtttatgcttgactgaggctcggcatagcagctctcatgctgcacggaacaggcccagcatctccaaatatatggccaactaggtacaacgtgtgtcgtcccactgttatttataacactggcaatgtggaaacaaccttaatttctgtaacagagatcaagtaaattatggcaaatccacttagtggaagattatgtaactgtttaaagaagatatttacaaagagtaacttgagagaagtgcatatgatacaatgtcaactggggagaaagagtctgaagatctgtctaccaacttgattacaactctgacaaagaatacagaacagagcaatgccttaaaaattaactctgaaagtaaacaaaccagatagtaacaggaactgtctctaggtggagagaatgttgctcaatcttcatttccttatacttttctgaactttgcaaattgtctataattttataatcatgaaagaataaacttggttttcagctttctaaagcgctagggtgatgacttccctgagccctgtcttcatccacatcacccccagcaggccaagttcagttgggttcaggtctgcaaacttttccaagccagcgattttgtgccatactctggtccaggcatggagagtggagccgagttagagccagtctctgtcctggaagagcccacggaacagttgcacaaaccagataactttaaaaccaggtagtgagaagacagacagctcagaataccacctggagcccagagattgaatggcctgatctttagttgagagatgaggagacaacatccaggctgagttgggagggcttctaagagccctctagctgaataaaggtggcaatggggtcctaggagaagatcctcatggtgcaaaggagcagaggcaggaaccaacctggcccacgcaggggaccaacttacctggggaacaatgaaggccaggcctcatgtgtgggcctcaaattcctcagatcatctgtctcgaccactgttgggggcgagtcaggttgtatgagtctctcactagggagtgggtcagttgtccacttgaggcttgagtcacctttgggtcacccaggttcaaggacagaggctctgccattggtcagttcaactgcatccttgcatctaaggggtggggtggcctaagcgcaaagcaaggtgcctgtcctcccaacacacctggatatccactgagatgggttacacggcactgttttgggggtgtctgattctggggagactctgagaccatcagtgtagttgcctcaaccattgtccaagatgggaaggagagaaggaaggaaataaacattctgagcgcctgccaaaatgtaggaaagagaggaaccagactttctggcactttgctaattgcttttatacatactacctcgcttaatcctagcccagtgcggtaggtataattgtctttgcttcaaagctggaaaagcatgcctcagagagggcaggtagcttgcctgaagccacacaactagtcagtggtggagccaggactagaaccaggcgtcctgccttccaggtgtgggctcttctcaccagtccacattacctcaatgacagggactgggtttatagacttattgagctttcttcactccataagtgagtgcacatctggactcctttgccaagcattttagtaccagagctgcaatgaacaccgtctatctaagcaacctggacttttgagccatttccactcttaattgctcctccacagagcacatgtcttctggggagggaaagagtgtatcaacacaactggagaatgtcacagcagagctgatgccaggctcatgattcctgggatgctgtctctcaggcatggcataaagattccagaactctccttctctactttcctatgggttagaggtaagcttctgatttgttagcaaggcaacatttaacccttctaagaaaaggcaaatgatgtggcagtgagatggggaacagccacccaggggaggcagccaggtatggcaggcaagccatccatggatcacagagggcggcatttaaatgatgctggacaaatcatggtcctctctgtgccttaaggactagggctgaattggagccaaggctttcagacttggggagggaggaagaagtcatctgtggcacttgttacaaacttgcagcccctcgctctctctagattgtccattttaaacactctgcccagctgagtctcagaaaagatgattcataacaaatcttagtctgtggtctgagctcctctcaggctcctgacctgcgcacaagtcagtctgcttgactcctttgctcttattttccttaggtgtctccaactagaagtgttctaatcagaacctccaagtcttccaggccaccctctacccgcatccagcctcacctcccacaggcttccccaagtctgccttggttcctctctttcctgcatactccacatccaattcatcagcaaaccgcaccctcttcctacgcagtgtatctgcagtctaccacttccctcacctccccggctacccactctggtgaaggtgaccaagactacagccataaccacatacttggtctctcaggttctactcttgccccctaaaatccatcctttgcacagcagacacagtgatccttttagaggacctagcagatcgtcacaccactgcttacatcgcccctgcccccagtgatttcccagtgatgctggtacaggtccaggccctgggtgatgtcagggtctgcatttctatgaaattcttggccttttcctcatggtcacaagaaggcggcctcatccaggcaggaaatggttgagatctgtggctttccagtttccagtgatctcatgccttgaaccatgcccaagggcactttcatgacttgcatgggcccagtgagtaccaagagaactccgctggcctcctggagctgagccccttctatgtgtcagtggctctaccacacacttgacctcagctcattgtggtgggaagaatcctaaagatgccctcaattcccatccgctagttcttcaagcaaacactaacctaggtactgctgtgaagggaccttgtcaagtgggcctgatgtgatcaggtgagctctttaaaaacagcacatttttagcttcttcaccccctaaagaaacaaccagcagagtgaagagaccccctacagaatgggagaaaatatttacaaactatttatgcaacaagggactgacatccagaatataaagggaactcaaataactcaaagccaaaaaagaaataatatcattaaaaagtgagcaaaagatctgaatagacatttcccaaaagaagacagacaaatggcccacaggtatgtgaaaaaaatgctcaacatcagggaaatgcgaatcaaaaccccaatgagatatcatctcaccccagttagaatggccattagcaaaaagacaaaaaatagcaaatgctggtgaggacacagagagaagaaaacctctatacactgttggtcgggacgtacattggtacagtcattatggaagacagtgtggatgtttctcaaaaatctaaacacagaactatcatatgacccagcaatcccactacgaggtatttaaacaaacgaaaggaaatcagtatatgaaaaggatacctgcactcacatgctcattgcagcaccatttgtatcagcaaagatatgagaacaacctaagtatccaccaatggatgaatggatcaagaaaatgttgtatatatacacagtggaatacacagccataaaacaatgaaatcttgtcatttgcagcaacatggatggaactggaggtcattatgttcagtaaaataagccaggcacagaaagacaaatattgcatgttctcactcatgtgtagaagctaaaatgtggatctcatggaggtggagagtagactgacagttgccagaggctgggaaggatattgcagggccgagggagatggagagaggttggtttaggggtgcaaaatacagttcaatagaaggaacacattccagtgttcaatagcacagtagagtcacttcagttaacaacatagtgtgtatttcaaaataactagaagatttgaaatattactcacacaaagaaatgctaaaggctcaaggtgacgcatattctcaatacactatttgatcatcacacattgtattcatgcatccaaataccatgtgtatcccataactatgtacaaatattatacgtcagtttaaaaaacagaacagtttctccagttggaggcagaagtcagagttatcagaagcacagaacgaggtctatacatcattgttgtctttgaggatggaggagggaggggaacatgccaagaaatgcagtggcctctaaaggttgagagtggtccccggctcacagcaagcaagaaaatgcaggccttggtcctacaactgcaaggaactgagttcagcctacagcgtgagtgagtttggaagcagattcttcttccagagtctccagataagagcccagcctggtcaacaccttgattttggccttattaaaacctaagccaaaggctgggcctggtggctcatgcctataatctcagcattttgggaggccgaggagggcagatcacttgaggtcaggagttccagaccagcctggccaacatggtgaaaccccacctctactaaaattacaaaaaaattagccaggcatggtggcatgcacctggattcccagctactcaggaggctgaggcaggagaatcacttgaacccgggaggtggagcttgcagtgagcaaagatcgtgccactgcactccagcctggatgacagagcaagactacatctaaaaaaaaaaactctaagctgagaacccagctggcctgcctggacttctgacctacagaacttgagatgacaaatgggttttcttttaagctgcttctaaatgtggggtaatttcttatgcagcaataataaacaaatgcactcctataatcttccatccttaatccactaatcctgctgggtagatattttcatcccccatcttaagggtgagactcagagaggtctagtccaccagggttccccaggggaccccagcctggagcctgacctctctgactccctgcctcacctcccctgtcttcggagcactcatggtgtgcaggcccagggctgggcgctacagactcagagatgaacctgacaaagtctttgtggctgaggagttcacggtttggtggtggagagttaccaatgagatgggaagaagacaggaagaaattaaccagagagaatcacagaacagaactcaatcacagctttcacagttagttagaaacttagagaccaaagcctgctctctaatccaacatcattttcggactagaaaggggagttggaaaaaatgtccaagcctagaacccacttctgacccctgtgtgtgctctctctgttaaggggcaatggtgggctctttcatcccttgaaaaacaaggaaccagtgaggaccagctgccacgctgctgcctccagggcagcagaacccgtcctctggaaaagcagaaaacactgacatgcatgccaaggctgggagggaaagaggaggtggggacggaagtgccacccatcttcttcctcccctctccctccctaccttctcccccatccccagaggccaggacaatgggggatgagtgggggtgggggagggggagaggcaatgacaagaataaaagagtcaggggacggattgattgattgatttgccttcaagagcccaagggtaaaattccagtgtggcaggagcctcatctcaggtgtccccaagctccctccccagctgtaagcgactgcctgtcataaagaagccagggaagatgaagcccaaaccacgggacttcgcaagcactgctctctggccacacgcactgttcctgtaacaccacatcaagacacaggggagcttaaaaccctgaccagaggggtggcatggccaaatacctttgcagcctggatcgcctgcctggggcagaggaatccttaagcatgaatatggaacaaatgttcttatggccaaggatggaatgtgacagcacaaagaaacactgggctgtcacttcccttccaggctggcacacctctctgtccaggaagccagggaacacgtggttctatgcaacccaacaggagactgatgtgggctctgtataggaatataggaaccccagagaggtggagctgccacttgcaaacatgtctctctaccaaaggggaaagatcgtgttctatgagaggcccttctgtcctgcagagtacggggtgggtttggacaggtaaatatgggctggggaagggtagattgccctgaggacctgcagggagggtggggaaggaggaagagaaggggaaagacagagtcatgaatttgtagaatggcaggaagccaggactctaggctggcagggagagacccagtggaaagtggccagagggttttataggcgggcacggctggtggcattgctgcaatgcacacctccaccaccttctccccagaccttcaagagagtgggctacacactctcaatgtgcagggttgtcctatttcttttgtttgtggaaatgggagagtcgagttccacgttgagcttgacacaacactggtgagacacggggcagcgagataagccctaaattggaagcagatgcttggggccacaggcatccttgggaacttaaacccccaagacatcctggaaaaagccaatcgtatgtaggttgcaagagtcagggaaatctctgctgactgcaggcccacgtcatgaaagtctctctatcacacatgcccacacacctggccaccccctagtgccaggtcagagtccctctgtgagtgcccacttgcattgtgcctatgactgccactgggccacccaccacaccatgtcatcatggccagttcacttccctgcctccctgttcagtctctgggatcctcaaggccaggtactgcatgctaatcatctcagacaccccaccacctcgctcaagcctcaacaaaaattggcgttgggtggaagagaactggatggacacttctggagtctgacattgtgccaggctctgagggtacaagttgactaagacctgcagcctgctcacagggtgctcaagggctcagtgagatgggtgttctaagaggcagtgaggtcctcatccctggaggtagggaggtgggctgggccccagcttggcaggaaactgagaagggtgatcaagctcccatgggtgagggtctagatggtttcagtgtccctctggcccttggattccctgacttctgagatcttggtcctgtaagacactggctccaaaacattcagctgcctctccacagtcttccagttgctaatgagcagtccatgaccagagggaggtaaacaagagctgagtcaccctgtggaatccccgagtagaagtcacctcccttcttaatagccattataaacacattaccagcagctctgtttatttgctgtttggagtttatgtagctgcacggaatgtaatatggaggatgagctacaaacatctgaccaccccacatttagccatctttgtgtctggtctgtatgtcattccacattcaacatccttgtgctggccaagaagaagaggtgggcgggctactgccagccccaccaggggagccctcatgggcctcaccatcaactaaatggtgtcctcatctcatgggaagctgaaggaccctttgggctgaaccccggggagccacagttttcagcacctgtctcatgctgttttctctgatcttcgactgccatcaatccctcagcaaggctgggttcctctctcctggcactacaaaaataaatccatggccgggggcggtggctcatgcctataatcccagcactttgggaggccgaggtaggtggatcacctgaggtcaggagttcaagaccagcctgactaacatggagaaaccccatctctactaaaaatacaaaattagctgggcgtggtggcgcatgcctgtaatcccagctattctggaggctgagatgggagaatcacttgaaccaggaggcagagtttgcagtgagccaagttcgcatcattgcactccagcctgggcaacaagaatgaaactccatctcaaaaaaaaaaaaaaaaaaaaaagatcagccaggcacggtggctcatgctcgtaatcccagcactttgggagaccgagctaggtggatcatgaggtcagatcgagaccatccttgtaaaaccctgtctctactaaaaaatacaaaaaattagccaggtgtggtgcacgcacctgtagtcccagctactcaggaggctgaggcaggagaatcgcttgaaacaggaggcggaggttgcagtgagccaagatcatgccactgcgctccagcctgggtgacagagcaagactccatctcaaaaaaaaaaaaaatccgtaaattgctggggacccatagcatgtatcagatgaacttgttgtttctggttttctcaaaaattgagctttaaaattccatttcacagatcaggaagcagagaccaagtagggtaaaggattttcctagggccccagttggccacaggccatcccggctctaggtggcaggctcttttcctgccactctgatccttccaaacctgttacccttccagggttccgaattttagctgatagcatcaacctccacatggtcttcatccccactgtatgtggtagaattggcttgaactccatgcgtcagaaatccagctccagtggcttaaccaaggagggatctctgtgttatgtggcaaaatatctggaggtaggcagtctggagctttgcacctgtgtgagaaagccactaagagctcagcttcctcattatatcctgttccaccctccttacctcaaaactctcttcctcatgatcacaagagagatgctctacctccagacattgcaacaactttccaagcaggaagaaaggtttatgtcacctgaatttttcccttttatataggaaacagcagctttgcctggtggatttctgtttacgttgcatcgtcacaactgggctacttgaccacctttaattgcaaggcacctaggaaggtgagcagtaactaatcacattgcttccctgaacaaagctgagtttctgctgggaagaaagagaagaatggatattggatcagcaatcagctgcctgtgcctgccacacccacttcctacatttacccagcctctgagtcccatgcagtctaactactcagtttcttgaaatccacttttctttttcttgccaagattatgccccagtgcagccccctctaaccctgctgtctgcgaggcacagtggggtgactggctgctgtccactcccaccctgccactatcaatctttccaaagcacagagcatgtggcttccctgttctcaaatccgcagttcctctccattgcttattaaagacatccagattcctcaagctgacactgacgtccctttacactccagccctaacctaattcttcccttgcctcctagaactcccgatgtccagccaccccactatctcccaatctgtgggcagtgggttctctcccaggcctcctaaacttggcttgtgcggtctccctgtgcttgacatggctttcttcgtgcctattctactcattggaaattatcctttaagtctcagctcaaatgccacgtttcctgtaaccatttactaagcaccccaatcagaatccacctctccctcctcagcgctccccttggatgtacagtgtgacatggagtccagctggttgttgcagagtctctgatggctaaggctgcccagcaccgatcttcttccagtaatagccttttggggatccgccccttccccatccttggtccatggggtcgtgaggttctggtgacatcatatgatacattaacctgcttaaacatctcctgacctggatatatctctagacttttcagttacattagactctataattccttttcacttgaatccgttgcttttgaattttctttcaggtgtggtcaaaagtcttcccagagagtgctgagcatctcttcctggctgggttggaaactccttgatggacaaggtctatagttcattgcactttgctccccttgcctggtacagaacaccttccttgggaaggaggagggatggggaaaatgaactgagatactgatgagataagggatccacgcccccacccctgacacctgtgcggcttcatcctggagccctctgggtcatcacctgtttcccgatgccttaattctgctgaaccgcattagccatgtgtgttctgaggcctttccctgacccctggcatttgtttagcaaagtcacactcagtaatctgtgcaaaatgaagtctctctgctggcatctctggttccaagccttgttctgtttaagctggcagggcctggctcatagtaggcatttaacactgtcagttgtttttattaccaggcgtttaatgcatgttcattgtatttattgtccaattctttgggtaagctgttgagtgaaacacctgccgcctatcagtgctcagtagacacccactaccgtaatcacagtgtggtgtgaacatgtaacagtggctcaccttccttttacgatcccaagtgatccatagagatccagtgagcccccagcctcaagccaccatcatctctctcctgaattgttgcaaaaagctcatgaccattctccaccacccacccttgcctccctgccatcggttatgaacacagcagccagcatgatctgttgaaaggttaagtcagatctgttgctcctcggctcagaaccctccagggcttcctcccatcccacgcagagtaaaaggcaacatgaatcacttggctggcccccaggccccccagatctggcccaggacccctcacctctctccaggctcactctgacccggctccaccgcctttccttggatgcttaggatattccaggctccttcccatcctacgacctccccagttgtgcttgcttctgcaaagctgctcccccagagaacggcacaccttgtccgcttccctatcatttgagatcctctaaagtgtcatttcatctgaaatagcatgtcccccgacccccatgctccacattccccctcgtgctgtcacgttttccagcatgccatgctcactgcctgacatacggcttagctacatgcttactcatttagcgtctgtgtccagggcaagcaccgtgtctgttcacaactgtagctccaggccaactgtgcacaacacacaggagtgctttcatcctccagaaaagtatcagcagaacccctcgccaaagggtatagttggtgaagcccttctggggccattctgcacttcctgtctgagaagaaaggacggatagaaaagtggcaacgtttattacgcatctgttatgtgtcaggcaaagggttaggagtttgccttcaatgaacacatggaagtggaaaaataagtcttcacccactgtctttgtctgtgtgggctgctgtaaaaaagtaccttatactgggtggcttatcaacaacagaagtttctcacctttctggagcttgggaagtccaagatcaaagccccagcatggtcggtgtctggtgagggcccttcctggttcacagatggcagcttcttgctgagtcctcacatggcagaagggatgaatgagcttcccttcacctttttaatgaaggcactaatcccatccatgtgattccaccctcatgacctaatcacctcccaaaggccccacttcctcacaccatcattttgggggttaggattttgacatatgaatttggggaggtgggggggcagaaacattcagatcatagcacctgcctatgctgaccaccgtgagccattatttaaagtaccacattctctccccttccacttcatctgcttgggtgcctctgctatgtgggtgccttaggcccccagcttcattgcctgttagacaatccaatagtgactaactccactttacaggtgacaaaactgaggcacaaagacgttcaaaacttgctccatgattcaattcaggcacatcaaatcctagagccccccgctaaccatccaaccccagatggagcacctcctgtgacatcccaacctgccggttcccatttcactcctgaccctgctcttgagagagccctgccagggctgatgcctggcccaggaagactgaaatctaactccaggtgccagatcacatgtacatctctcaggtgggtctgctggatttgggtccagcttttttttttttttgagatggagtctcgctgtgtcgcccaggctggagtgcagtggcgcgatctcggctcactgcaagttccacctcccaggttcacgccattctcctgcctcagcctcccaagtagctgggactacaggtgcctgccaccacacctggctaattttttgtatttttagtacagatggggtttcaccatgttagccaggatggtctcgatctcctgacctcgtgatctgcccgccttggcctcccaaagtgctgggatcacaggtgtgagccaccacgcccggccttgggcccagctcttaaacctaccaccccaatgttgttcacctctcagcagcagacacaccagaggcatggatgcatgttgaattctttgagtctgtttgctgctgttctcaagagcagcatattgtctgcactgggcctccgcatggatgatctgggttgttgatgggtagagtcctaaatgtaaaggtgggttagcatctctcaaggacttcagtgtcctacaaccccaggagactggatttcacagaaggcttttcctcctgcaccaggtggctgccttcttttctctctggttatgagggacataaccacggcaaagtcaagagacctctggcagcccctgggcattgccagctcctgtgtctcttgctgttcttccctgtcctgtgccagccccactgaagctgcatggggtctgccctggcacatctctcctgcacagccacagtctgtggacacgcctggctacgctgaaacagacccttcagtcatgacttcttccactcatctcatgggctggtagctgcctctgagaacctggaggcctcaatctgtcaggcaagatacactttctgagcctccactattgcaggcaccttctaggcactggggacacagccatatggatggacctctgcccccaaggagctgatgtcctaggggcagagtgtaaagatgtaagatacacatgagtaagacaaagccagaaaccaagggtgtctgagaagaagagcagggctcatggagaaagtgacagggcagctctgtagaggtggcgtctgtctgagtcctgaatgtcaagaaggcagcagcaccaagatctcaggaagaggcatccaaatggaaggaggagatgcgtagaagcacagagggcttgcagggtgtggagccaggataaggtctgtgtagctgcagctcagagggagacctggggacatgagggtgcgagacaggcagggcaggggcgctggcccaataaagggattgggatcccattgacagtgtgatgggacccactggagggcattagccggggcgtggcatgatctgacttacacctcagtgagaccacccagctctgtgaggagagggcaggtgggacatgggtcagcggccgctgcaggcccaggggagctggtggcgcctgggctcaggggaaaggtaaggtgctgaggggcagtcacctcaggatcagctttagaggtaaagccatcaggagtaactgcggggttggtagtagggtctcaggaagagaggaatcaagggtaatgtctgagttttgactgagccacaaggcgcgtggtgatgcaatctcctgtctcagggaagactggagaagcagcagccttggcggtgcgctgagagtcagttgttctaccttgtcacattagtgggaggtgtgtgttattcatctaggagaagaggcccagtgccgggtagacagaagggcctggggctcagaggagtccaggattcagaagggaattttagagtcagcgtatggcagatggcatttgagcggtggggctgcgtgagctcccctagaggttgtagacagagggaggaaggctgaggctggccccagggcgctgtaccttccaggggtcttcttggcgagaaggaagatccagcagaggagacagacaggcagcggctcgtgaggcaggaagcctggagagggaagagcttccggaaagacaaggttggtcacatcacatgatataggagattgagtcaaacgaggacagagaagtgaacactcgctgtggccacataaggcatcagttaccagtagaaccatctcatggggtatgatggagacaagaacccaggtagagaggctctaggagagggtgagaacgtgagccagcagccaacgtgactcttcgaggtgctgtgaaggaggcagaaaaggaggtggtgaacagaagaagatggacaatccaggggtgttcaaaaggggctgtgcgggctacttagggacgtctggcaggaaggtgtcattgatgacaggggaaagagatggaaataagtagagaaacaaagtcctggagagggggagagggaaagggatcctgagccatgtgcttagaagcagagacccatcttccacgtggagcatgtggagaccaaacatgctggcaggctgggacctgctgagcacttctcatctgagtacatagactctctctatcaaacatgacaggaggccactggccaagagagagagaagaaagcaccgtggaagatgtagaggaaggagtggtgaactaggaaagtgaaagagtacatttctagggaagtgtgatggatttagagaaagtgttcattgccctctagagatctgtgctcctaaatttaaagtgagagcaactagcagcattgtacgatgtttcccagccataatcagcttccaggtgagggctgaggaagagcagagttggggcagagatgttttggaaggtcatgaggtggaaaaataggagacgatagcaagagggattcttggaatcaagactgaatgggggttgggcgcagtggctcacgcctgcaatcccaacactttgggaggccaaggcaagtggatcacctgaagtcaggagttcaagaccagcctggccaacatggtaaaaccctgtctctactaaaaaaaatacaaaaattagccagatatggttatacatgcctgtaatcccagctgctctggaggctgaggcaggagaatggattgaacccggcaggcagagggtgcagtgagccaaaatcgtgccactgcactccagcctgggcaacagagcgagactcgatgggtggctgggctgggtggcagagatgatcactggctgtcccttgagatcaggcaactggaaatgcttgggattagacagcgaagtggctgctgctggtgccctgtccaagccctttccagaccccaggaggctgtgctctgtgcactctgcagaccttggccaatgccagcctcatggctgccacaaagtttgccccggagatagaggcactaactcattggtgcgccagagccccccatgggatgaggcagaagctgggctccaaccagaccacctgcttagctttttccacctgctgtatcctgcttcctttgccccccttttcatgggagtactccccagtaaatcatctgagcaagaatccaacctcaggctccgctttaagatctatgaattttcatgtgccaagaaccatgatgggggtggtggtggagaaagagccagtgaatccagtactaacaatatcggtgagcaaggagggtgatggggcagtcaggaaatgacagctggcaggagtcggggtcatgaagaaggaccatgcctgtcaaaggggctttgaaaaggaaggagacaggtaggggactggctggagggcaaggaaggtattggccctactacttccagatcctgcaattatggagtgtgatagaaagaattagccacgtaagaagatttgggggaaagcaggactttcaacagacagccaagtttgggatggtataagagggtgaaatgatcagaactcatgataaaccaagagttttggatggctcacaggaaggggtggataagcaaggaaggatgggtgatggggtcagattaggaaatattcagagcatctgtaggaagtggaaagtctcagatgattcaggaggctaaggttctgccagaagctgaggggaagggacatttaattcttggtggatttggtcctggggctgagcgctcatactgacaagtgccccagggcaacagactcagcagaaggatgtccgccatcatggatgggaagagcaactttctcaggccatttatccaggttcctgaaaaactaatttaactggtttgcatacacaaaaccaagggtttagttggggtctccctgcctcttggggatttggaggaatttcacccaaactcccaacgtgtgggcactgagcctcccaaggattcctccccaccccaccctccaaccctcaaaatgatttttctggctgtttgacagcttgaatctccagcgctgcactcctgtatcccggagggactgactgtttcctggcctcagctctctgaacgtgaagctcaggctttgcttcagctgccaaattttgtgagttgagcaatttaaggcacagaggagcaggaggaagaggggcagtgtgcgtgcattgctctctgccaagctggggctcaccgttcctctctttttctcaccccactgacctcagcgtgagtgcatgtgcacacacacacacacacacacacacacatgctcacacacatcagagtagtcagcatctcccgtggtctgaaggaggatgtttctgcccacacgcaggccctgggggctcagcttccattccaagtgcctgtccaggaatttatttccaagacatacaatgctcttattgaaagaaatttggaaagcagttttgtccctctgcgaaaacaatgtggtgtcgtggtcaggggtacaaactccgggatcacgccacagcaaggagctgaaccttcctgagccttgatttcctaatctagacaatgggggtgataataccacagttgacattttccagcacttttcttgggcttggcactaggccaagcactttataaccatcatcttagttaattccaacattagccttacgaactgggaattactctcactgatcaaaggataaaaatgaagttcaatgagtttaaataacttgcccaccatctcctggtttttagttggctgagctaggattccatggcgggtctttttcactttgaagcctttgctcttaaactctctgcaccatacagagtcaggagccctcggagcacctgctggctctgccactaacttgacccccctccccttgggcctcagttgcccaatctgtaaaatgtaaaaaaggtcccttccagctctatctcaattgaatttttgaaaatggcagtcttggccttgaaagagttaacacagatgcatgtgagtcaaaagtcccttcttactctgctttgtcccaagtttcctaagatagctttgaagaccaaaagtgcataacggcttaagcttgaaggcagagtttaggaggaggtgagcgtgcaaatagccactgcagttcttctggaaggccagtacattatccctaaatattgcttaactttttatagtgtcctattttatcagtgatgaggcttccaccatgaaatcacaatattagaaaccgactcagagagcacttgggtttaacagagaaacaggcaggggaggggggtttcctgaggccgctcacatgccaggcttcatcacaagttcagtacacggaggggaagctcaggtcctgagagggtggggcgtaccctgctccacccacacacaaatcgcggcagagccaggaccctgagcagatctttgagcccagggcgttccttccgagagctcctctgccagtgcctgtcctttctcatctgtgtttttccagaatttcttaaacaacactgggggatgaggggggctgcccagtgaccagggctctgggccctacctggcttcaacctgagcaactttgtttttatcaatctaagattttgttggaaaaaggctttggttgcttacaaaattttttaaagtttatgttccagcctgggtaacatggccagacctcatctctacaaataatttaaaaaaaaaaaattagccaggcatgttggctcttgcctgtagtcccagatactaaggagactgaggaaagaggtcgagattgcagtgaggtatgatcgctccactgcactccagcctgggtgacagagccagaccctgttcccctgacaaaagcagtttggaaatgcagctacactttccacattcattttttttcttgctcctaaattgatttcagcaaaaaatggaagctccctgacaccaggaatgcagagaagggagacatacaaagcagctctgcatttggggcaaggaattcaattgcgctgtagcagtgtgagtgtgtttgtgtgtgatatgtgtgtgcatgggtgcacgtgtgcatgccccacacccactcacagcgagtcagggtgacaggttttgcacagacatcctgatccttgctaagaggtaaccacagctggcacccatggccttgtttatgctcccagatgctgagcaacacaaatgataaatccaagcaagttgtttgcctgcagagttcccggcctgctccaaagttgcagctgggggaaacccacagggctctagacccacccgtgcaggtagagcccttccatgtgcttgaagatggcacagcgggaaagtcccagcagccaggccatctggtggctaagaaatgaagttccagacagagccctgggttggacacagtctggtctcagatcagaccttggtctctagacccctggcatgtcctgggcttcagcggccttccccagatgtcttccggagccctcaacttcatgttcacccagctacaaccatccctcacctcagtgagcttctgactctgttccagcgcacacctaggccaacaggaagccacccagaccccacggcatgatgtgcgaagcccttcatagcctgggcccaccaggaaggcactccatcaattcactcctgactttattcctgaattcagggatacacaaatgcatgatccaggatctgtctcccctctgcgccatccagagccttgccagcacttggcagaaaggaggtgggatcagagctgatggagaatagaataaataaaagaaccaatgaaatatgcaagagtccactgaacactataaagaactgaaatcataaacgaaagaaattattactattaggaagaatgtgattatcacctgccccactgggcaacttttttggccctgtgacagggctttatggaaataaataatttagctttaagaaaatcagtcaaccaattttagaaagtaatgacacctgttttctcattgtagaaaactttgaaaacatgatgacaagattagtcacatatagtccaaacaaccagatatagcccaatgacactgggtgtattttcttccagtctgctaggcaagtgtgtgaatgtaaaaagtaatgtaagtgggatgaaattgcatactgttttatatcctgtcattttcaggtaatattttgctgtttatactttgctatgttttgacccctgaagtcaggttccagcatccccactttctggctctgtgaccttgggccattcatttcaccttgctgagcccctatttctcatctcagaaataaccacactcttactggagccaatatcaattttctcctctttgtgaacatattgttaaactatatttcccagcctcctttgcagctagatgaggccacatgacgctcttctggccaatgggatgtaggaggaagtgatgtatgccgcttttgtgcttggctcatagaatctcccaccaatggtcctccaatttccctccttaccctccagggcccccatgctattgagttgcactaaggcattcaggaaaccatgagatggaagagccaccagcaggacccaggatggaacagatctgggtccccatgtcagaccctggagagggagccaagtggcctatgatgtgaacaagaaataaacccatgctgcttaaaggtatcaggatgtatttgttgctgcagcccagcttaatctgacagctacttacctcgtaaggcatgctgtgccatttaaatgaaatatgtgacatcagtagcccataaaaagcacttcaaatctgagccattacaaattaaagaacattaaaggataaataagccatttagtaaattggataatacacaccgtaaggtttgtgggacttcagggaagagagaaatcactttggacagcagcgagcagtaaaaggcgtgttgaggggaatttctaggatgtgtgtggctgtggatcagaagaagatttggagatgtttcattcaaccagtgtgagtttgccaacctccaggaggcaggaagagcagtgaatgggggttggcgggggggccctgtatgattacaggaaggtgagaaagcacccgactggagactcatgcccagctcccagggcctgcccagcagaagctgatcccgcctcacacagaacctaggctcctctctccaatcggcctctctgtctgttcagcttcaacacaaagcctgaggaccccctgacattccaactccctcagccacgcccagtccttcatgaagtcctacaattccagctagtaaacacctctccaaacagaatcagcatcaccacctccctcctaccatcttcgaacagtcaccttcatctctcccctgggctgctccttctgtacctctccacacacatgcccgccaaccacacacatgcacgccaaccacacacatgcacgccaaccacacacatgcacaccaaccacacacatgcacgccagccacacacgtgcacaccaaacacatacatatatgcaggtccatctcccacaacagcagagcgccctgggaaacgcccattggatcatgtaccacaccccataaatacacaccatgatgattaatgtaatgtgtcaaatcagctgagccactgtgtctagatgtgtcgtcaaacattattctggatgttgctgtgaggatgtttttggagattaacatttaaaggggcagactttgagtaaagcagactgccctccccagtgtacaggggccttacccaatcagttgaaggcccaaataggattaaaagactgaccttgtgcttaatattcatctttcccaaaaatcaatgtcctccatcaaggagccgacagagcctgctttgttcacatggagtccccagtgcctgcggttggggcatgtcataggcctgcatacaatttaaaagactaaataaatgaatatctattataatccaaatatgtatttccagctggacacaacaatgatcgttccttctcatttccgatcacatattgtttggctgcatgacgaatgctcacactcaaaaatgtctccatcattacacaatccatgatgggaaactgactaaagcaggttgcctgtggcagcaaccccacccgggacattcagccacgtagccaagcgtccctgctgcccctcctagcctttccctccccaaccctcaccatccagccgaacatcctgatctcagatgccaaggcccccaggtctccccccagcttccctccttcctttctaataagaggagactccgctctgaggctaattctctgtgtagcctgggtcatattccttaacctctttggctctggatcctcctctataaagtgagagactggatcagagggttgtcggaggccccctggccctgactatgcgatccacaatcatctacgtctttctgcaccttggcctgactgccccttctcacactgccaggacttccggtggctcagagccaaaacccactactcagccgttccaacccaagtgattcttaagccaccgcaccatgccatgccagccttgccagcctggaggtaaaatcaggatcacaaatataaaacaggattcttctccctctttccttaactgcaattgtagaagtggactcagctgtcctcaatgggtctctcccacacactcactcatatatgcacatacacatacacaaacactcacacatacacattcacatcacattttctttgtttcaggcagggtgttttcattatgagcaacagaaaccaattctggcatatctaaggaggagggagagaggaagcagagaaggaccatgaagaagaggatgagaaagaggaaaaattggaaagtctcccagaatcacaggagcctgaacagcgaggtcttgggaaggacaaggagcagccgggtcagagatccaggaacaggaaccagccagcgacctcttcagagctggacaagcaggatcaccagccaccactgcatccttgtttttgttatcaaattacgtcatacacataagagattatattcagaacatatcagtatcatttcaaaaatatacaaataaactggcctccatggatccaacaaccaggtcaagaaatagaacttcaccaacaggtctgaaacccccaggagccagtttagtctgcaaagccttaactcttgtccatcctcacctacacgcactcaagggtcaagctgctcttccaggaacttgattggcccaactcagtcatacgccaaccacttgattttaagtctcaatgaaacttcgtgcactggggagccagaaggccaccaaaaggcaattggggtactactatgagaaatgtggacctgagtactggctggcacagcaagtgtcccctggtaggttacccttggaagacttgccccaaaagatgcttctttcacctgtgtttgaggagttttttttggttttgacttgcttttctttatacctcctctttgacttagatgtgtgtccatgggactgagccaaaacaacgcttaaatggcagacagcaggctgtgcccacaacctcttttctcctattttggccatttttgtcttgaacttagcaaaaatggattattccgctagaaggagttatttcccaagaaatccctggcttctttatataaagacgccactgatgggactggcctatggcttgaatcctaaggtgtgcccagcacccccttcccaacaaagaaggcagagatgagttgaagccaacgtaatggtttctcctgttgctcagtgtgatcaggattactagctgtccgccaaaacttattcccctgatttcttagttacaggcatgtagccagtgatgggctgcccagttagataacactccccaggctatcttggatgtgatatgtgctatttgcaggtctagaatttaagcctcagggcacgcttccttctcactctctttttccttttctcataagctggaacctggacatggcagtgacccaactctaatcacagaaatgaccaaggtgacctggagaataatggagtgccaccaccctgacaagctgaatggctcgctccaggactgttacgtgagagcgagagattgcaagccagtcctcacgtaaatgaatacacctacaatcaaaaaggcctttatctcagtacctagaggaggcatcccatgatgtggaaccaggaaaagccttctggtcaacagataccaacccaacttctagccattttgtaggaccttggccttttggtaaaagcatttcaccccagcacactgaccaagaaagtgcacatgaatcctgaatagaataatgcatttctctatatttcattagccgagataaggggatctgaaagaatgatacacaagactgacagaattttggaaggcaggacaataaaaaaaaacgctaagactaaattatagtctgacgaagattgaggagatagggcactggggataccagagattaatttgtaagaactgccaggtgcagtggctcatgcctgtaatcccagtacttcaggaggctgaggcaggcagatgacctgaggtcaggagttcgagacaagcctggccaacatggtgaaaccctgtctctactaaaattacaaaaattagccaggcgtggtggcaggcacctgtaattccagctactcgggaggctgagacaggagaatcacttgaacccaggagggggaggttgcagtcagccgagactgtgccacagcactccagcctgggcagcaagagtgaaactccatctcaaaaaagaaaaaaaaaactttgtaagaaccatgaggggaaaatgagaagccaaagaaaaggacacagaaaaaaacaatgagaagcatagacaaaaaaacagatgcgaaatctgcttgcaaagtaaaccttagattcagagggagaactctcaccaacaaggacagaggggaagggagatagagacggagacagaaagggaaagagacagagtgagagagtgagagagcaaacaaggaggctggtgttaatgatcacatttacccacatcaaaccctaggatttccatctgctccctggtgcccaagttccatcattgccaagatggaaaccatctggctgtatgcacgcggccctcccaatgtttttcccacaacactggtgtttttccagctccccgacctcgtggggaatttcatgcctgagtcagaggcacaatgtcaaccgggcctcaatcctctcccccactggtctgtcattgccagtggaagccattgcccagtgtgttggccccgcgcacattcactgagccagtctccctctgacccctcactcggctggtttcttacggtgccatctgcccagagcataaccagagactcaggtattgtcccaggtcaggggaggagggaatgtgaagagcctgggtgggcgctgagataggggacctgcccgcaagagctgacccttctgtctctcagttgtgtaacctgaggcaagtcactgctcctctctgagcctcagtttccccatatataagatgggactggtaatacctatttcacagttgtgtttgaggattaaataactattataagaagacttaagccaagttctaaggaataggagaggctgactcatagctgataatcttgtattattattggtaggcaggtgaggaggtaaaatcttcctggctggctccatggttttttaaaacatgcccctagactatatctttgtgtgggtcccggtccaggcaaaagcctccccagtcagtggccaagccccagggccaggcatgaactcccatgacctggagccacagagaacgaaaagccttgagctgtcctgatgttgttgccctcatgagtaatgaggaggcactaaatgagcacaatattaaggagatgtggtgggacccagagtgaccttggggaggcgggggcagggaagggagcaacgtccctgtagtgccaggatctggacattacacagggcacgtagctgcctctattttcagcctttactaacctgactcaagtatgccacattctcctccaaagatgcaggaaggcagttctggaagcttcctcctacccatggtcatggatcaattgcctagaacccagaataatagttcctgagagatgcatgcaggcactgtgcatgcattagcttgttgaatcctggcacaagcctagcagataggttctgttgcagctgcattgaacagacgaaaaatcaagctaagtaccttgagatctgcagcagaggcagaggcagaatttggaccaggcagtccacctccctggctgctgccctgcctgccattctgggaccacaggggacctctcttcaccatgcttcagagggcttgggtgtcagcaccccgagttctggaggtttggctgacatggaccccagaaagcttccaggacagagagagcccatccaagttcagtcagctcctcctcagggtcacacgggctatgccctgggttagcagcctctgggctggatgagatggacacacagcacctctgagactccacaacatctgatcttagcaccactgtgtctgcaagtggatttgagaatgccacaaacacccaagaggctgtttcttaacctctcagaagcttcatgtgcaatttaaggcttttatttccgagctgggaatggactactttgtctgttgtaagatagcttagggcagcagtgagcatagtggtgatgcctggcaggccaggggccaccaaaagtccatactcattctaggagatagcccactgcatctactatgcaccagacactgctctaaaagctcagagtccactggtgaacgagataggcaaggtccttgatgtcttggagtttacgttctagtgaaggagcacctccagtgagcgagtaaacccatggccctcaaaagcaggacagtggtagggctacgaggaagacaaacaatggtaaagagatagaggtcaaagcctccgtgcatgtgtgtgtctgcgtgcgtagcatccatggggtgtgtacgtgtgtttgtgtgatgtgtatgttggtggagtttgcattggtgtgcacattgtgtgtggtttatctgtgtgatgtgtatgtgtgtgttgtgtgtggtctgtgttggtgcgtgtgcgctggtatgtgcgacgtgtgtttctgtgtgtgtgcatatgtgtatgtgttgtgggctacttccgattgggcggtcaggcaggcttctctgggagaagtgtcacttgagccaaagtggccaggggacccggctatggaagatgagacaatcagggtgatggttggaactggccgcccccaggattaggaggctcccagctgtggcatgtggtgccccatcagccctcctcttatgtgaggtcgctcctggtgaaggaacatgaaaggtgtcctcccttccagggtccacagaagggcagaatgcaaacccaggcctgagcttcccaacccttttgaactgctggcaagattacagctgtgctggtggagcttcccaaacacccggaggaaacccatgccccagtggggcctttctccaaacaagtcattgttcttaactgcctcttgcagggaccctgcccagcaggcacagccctcaggcatccactagctgtctagagagcccggattccctgggggactttccaggcctctgtggcctgcccaaggtcacccatctgcatggagctcattcatttcttctcactctggagtgcaagaggccagacgttttttgcacagcaaaactccaaaaccaaaaccacaaaagtcctgtacctgcttatctacgcgttccattccatccatcagagtgaaaatccaagcaaggttttcatatgcctgatactggctgactgggtaaccatgcacacataaaatcatttttttactcatccacctttctcaagtgaccacaggattggagacagtgatgtatagaagatgagatcgctgcctccaggactccatgggagggagaaaagacatccatccaaataatcactgagcacctgctcagctccaggtgcccagggaaggggagtaatctcttggcagacacaaagtaagacagggaggtacaggcgcagtggatacacatggcagggcaacaagcccctgcaggctgagcttccagagaaggttctgtggggcaccgacggttaagctggggcctgaatgataaatgggtgttgccagatgcagggaagagtgatgaagcaggtggattacttgaggccaggagtttaagaccagcctggccaacatggtgaaaccctgtctctactgaaaatacaaaaattagccgggcgtggtggcaggtgcctgtaatcccagctactcaggaggctgaggcaggagaattgcttgaacccaggaagtggaggttgcagtgagccaagatctcaccactgcactccagcctgggtgattaagcaagactccatcttaaaaaaaaaaaaaaaaaagtaacgaggagagttccaggactagcagaggaaagatttagccagtacacactggatattaaataccaacatacttccttatgtatgaatagataccttcccacatcccatcccaacactcagctcaccccaacccctgctcctggaatctccttttatggggtaaatagtgtcccccaaaaaggagttgatgttgtaacccccagtagctgtggacatgaccttatttggaaatagagtctttgcagacaatcaagttgaaaggagatcattggggtggccctaatccaatgtgttcttatataaaagggagtaacttggacacggatgcgcacacacagggagaatgcgatgtgcagacaggagttctgctgccacagctaaggagttaccagaagctacagagaggcctggaacagattccccctagagccttcacagggttcccggccctgcccacaccttaatgtcagactgttagtctccaacactgtgagacaatcaattcctgtcgtttaagccgctccatttatggtactttgttgtggcagccgtgggtaactgacacactccctatgatccaaacgttaaagaggaaactcctggtagaccaagaggtctccaagaggctgttccatcatattgccattggtaaagattttaaacatcactcctggagaaagcaaatgtaaaagtcctgagtccaagatctctctgaaactgaaagaaagctccaggggacaggagagagagcgtgaaagtgggaagaagagatagcaggagccaggcaccaccggtggcttggtccttactctaagagcaacagaagcacggtagagttttaagtgacaaatgctgacttacgcttttggaagggcccttgggctgccaggaggggaaggggcaaatgtggccgtgaagacactttgtaggaagcagagccttatccaggccggagaggtgggtggcagctctgtgctgggggtgggaacagctgggggagtcctcacttctgttttgtctgtaaagtagcaggaaaggttatttgcgtgggatgatggggaactagaaggtgtcagggtgtgaaggacaagcagatgggaacccctgggaggctctgggcagcccgtggggtgctgccaaagctggtgattctgagtcagcagtggtgttgtgtgtggtctgtgttggtatgtgtgtgctggtatgtgtgacgtgtgtttctgtgtgtgtgcgtatgtgtatgtgttgtgggctacttcagattgggcagtcaggcaggcttctctgggagaagtgacacttcagccaaagtggccaggggaccgagctgggggaggcccatcgtcagtgccctagcgaatgtggaagtgctcgagggacagggaggggccgacggccatcgcaccagtgagggggaaggcagacgcagtgtgagcagtccagtaacttatctggaaggcaggagggttataggcagaaaattaaatgacagtattggctaaaagtggcagattcatcacacgtcagtgtgctccctctcccaaaacccctttaaaaatattagtaaaggtgttgcgatttttcaaaagatgttgctgtacaagaacacagcacacagaagatgctgcagtagcagctgagagtcaataaactgttagttgactgaaagcaagccagggatctagcagagtgaagacggtgtccacccaagggcatgaggaaagggtgccgtcaacaagccacttgaccacagaatctaggtgctcagtgttttgaagtggcaggtgtcacaaaaggagggcgttagatatgagactcaagaaaaaggagattggataaaaatttgtctgcaaaatggttgtgttctcagtcccctccttctagcctctgttacgctccctctgacccaaacattaaagagtagaccaagaggtctgactccagcaatagcttcttctcccttcccccactaaatacctccagcccctacactagctttactctctgggaaaattaaatgggagagattagaggtgaggcatgaggctgaacagcttagggttccatggaaatctgtatgtggagctctggcaccccaggctccttctgggtcctgttcccacaaggccgatgccaggcatatgcttgtcaggcagggactgcagggctctagagggaacacctgcagagctgacattggaagtgctgacgaaaagagtcaaactctgtaaaatatttgaagagatttattctgagccaaatatgagcaaccacggcccatgacacagccctcaggagatcctgagaacatgtgccagggtggtcagggtgcagcttggttttatacattttagggaggcatgagacttcaatcaaatacatttaagaaatacattgatttggtccagaaaggtgggacaacgcaaagtgtgtggtggggaggggtgtttcaggctataggtacatttaaacattttctggttgacaattggttgagtttctctcttttttttggcattcctccttttttaattttttaatttttattttttattttagtttaagttctgggatacatgtgcagaagggggaggtttgttacatagatatacatgtgccatagtagtttgctgcacctagcaacccatcatctaggttttaagccccatatgcttaggtatttgtcctaatgctctccctccttttgcccctacccacagacaggccctggtgtgtgttgttccccctccctctgcccatgtgttctcattgttcaactcccacttatgtgtgagaacatgcggtgtttggttttctgttcctctgttagtttgctgagaatgatgacttttggcttcatccatgtccctgcaaaggacatgaattcattcctttttaaggctgactagtattcctagtgtatatgtgccacattttctttatccagtctaccattgatgggcatttgggttggttccatgtctttgctattgtaaatagtgctgcaataaacatacgtgtgcatgtgtctttatagtagaatgattatttaatgggtgcaatattttatccttgtgaggttttaataataatttaattttttttgatagtcttcactgcttattcttggtctctttcctctttgcttgtttagtgggtttcttcaaatggccagtgctgctggccacctgcttacactgcatagtgagctgggcccagggtctgcacagctggtctggcctcagtgccaagagtgcttcatggaggaaacatccagcagcaagctaggaatgccggtgggggcctttctgaggactaagctctgatttttcaatcttgcccaaattcctatctaaggggtcttgggagtcatgccttacaaaccatacattctcatcagatgtgttttatttaaccctatatatcgtgacttactttccaacctgactctggcataatattatgagataaggaggaaaatcaaaatattttaccccaaaacatttttctttgctgtatcttgaaatggccctgcaaagccgtcctttgtgagggaaaatttgcatctgaaatgaatctctattaacatagctagatctttttcttccaggccctcccaatcctgaagagattaactaagagtctagcacattttaaagatctgaataggaaagatttgtcatccattgtctctaagggcagccaatataagacttcaaaagaaccctggtctccacaaacttttatcttaacctgaacatttcctttctattgatcccaggtctttagaccatttgactcagcaatcccattactggatatatacccaaagtattataaatcattctactatgcaaacaccatccttggggatgtcaatgttttgccaagcaggaagagcagcagggacagacatcagaagggctcttactgtcctcatgggatccaaagggcacaacacaaaggcagtgaggaaagggagggtggctctaggctcagagcctggtggcgctgccactgtgtgcagtgaccatgcagtggggatggggcctgctggatggaattaagtcacaggacctcactggatgaagctcgttaggaggggctcagatggtggggaggggtaggaagcggtcctcttgcccaaggacccatggcactggtatgggtgagcagctcaggggaccaactctggggcaggcattacagcaagcagcggccggagtgtgaacagaagtttgctcatctgacacctggggctgggcagagcccctcccgggggcagctctgggcagcctgtggagagactgatgcaagacaggcaagttcagagaacgaaagattccttccagctgagggacacctggaggaggggacattggcgctgagacgttctagaaggtgggacttgtaacatggaaagatggggaaatacacagcgtggatcttgctaagtgcagggggctgttcaggcaaaggctcagaggcagagaatgccagggacatgtggcccaaatatgggaggtctggagcggggtcgttgtgagtgtattggttcttgtgggtctttcctgcctctctgaacaccctttctgggtgtggggattctccacctgatgagggtggcaaatgctctcccattcttttctgcacctggggtgcaggtggtaaccaggattccctcataggatgctcccacatgggcctttgaaccaggagccagtgatggggagaggtgagcacactaggaacccgtccaaggagggtggcagaagctgcagccagctcccagatgcattggggcagcgtgagactgtccagcgtggccagggctcagcagcagcagcaactccagatctgtgaccacagaggcagcggcagtgtctacgcaggagcagctctgaggtgacgtttgggcaccatcattcctggctgcttgtcccctagaattcccctgacccccaccagccagagaactgctgagtccttttcgggtggaggagatgcacagaccgcctgggtttctattgtttgtcttgaagcactccgtattcaggggaagaaggcgtttgtgattcaatcaataattattcacgacacacttccctttgccaggcaccgtgccaacctccataacaacgtaattcacttttgcttccattagattgctaaaaatgtccccaaataaaccctggaatcaaaaaagggaccttcagaaaaggaaaggtcaccttctcactttctgaatcatctggtctgggaaaagagcctagctcggtgcccggaagggcggccaatctaacagcctccacccacatgggctctgctgcagggggccctggctattcctggcaacaggggactctggattctgcttccaactctaccccttggggttcgttccagggccacgtttaggaaggtggtgtctatttacggggcaggagcgacaggatgtgttgctcagggccaccttgatgtctcggggctggctcctccctccgtccagcacccctcccccaggactgccacatctcccaggactgccactctcatgactcgccaggagaccaggggaccctttgccacctccgatgtgtagcgggtagagggctgggggtgttcatcttgacagggagaaagcgggaccagcttcccagctcagggagtcctaggctggcacatggggacagaggtggcttccatggccatttgaagggcagatgagtgagaattctgggggatccatgaaatggaataggaagggtatagactgaggagtcagccagaaactgggttcacagctggctgcagcctctctttctctggccaaggggtgtttatcaagcacctggcatgtgcctgcctgcggatcagtggatggcacagacacagcccttgccctctgcacgttcatggtgacacgggagaacagcaaatcaacaagctcaccactccatagaggaggtatgctgcatgcagggagggcagaaggcacctccctaagctgctgcatagggagggcagaaggcaccgtcttcgtcaggatggcaggggaggcccctgaggaggagccactgagcttgtgccttggggaggagaggcgctggacatggggggcaaggggagagctttcctgacatagccagtggcctgcggcagcacggggcaggtgaggaggcctgcagagggtggtgatgggggctggggattgctgagagacggtcggaggtgtggggcactggtgagagacggtcggagatgtggggtcctggggctcacacccggcaaggtgagagggtgtttgggttttattgtgggtgcagtggaaaccagaggatggcataccttcttaaaaatttctctggacagtggttgccaaggggttgggggttgggaggactttgaccacaaatgggacacgcaggccacgagggtgacgcactgctccagggggccagagccgtggttctgcacctgtcaaaacccacgtaactaaacaccacagaaagtgaactgtactgttgtgcaatgttttctaagttctttaattgaaaaggcccttccagcagctgtatgaaggtgtggccgaagtgtgggaggcaaaggaggggaagtgagaaaccggccagagtcccagaggagacccctggtcagagtgtctgggtgaggtgggtgatggccgtggggagggggctatgagctcaggtcctctgggagcctctgaggagcctcagtttcctcatcagggacactgtgcagcaatttccactcaggagctgtccatgtggtctggggatggtgcctataacctgcctggcagggcctggctggagcaggtgctcagcccttaggagctggatgattgacctttttccagagggtggctgtggctggcctcagggtgcctggaggtgagccatccacccacggagcagggagggggccaccttcagaaaacagacctgaaggggaactgttcaacagtgaaggacacctggctggaggcccttggcctacagatcaagtgacgtcaccccaagccgaggaatgtgacccagaatgttgtgtacttagagggcttctctctcccagggaggtctgagcatttttatgggggccaaatcaggatctggctgaagcaccagccttgggagggggaaggtgcagggcgggcagctcccagggaaaggtgttggctcaggactggagctccaggctgcagaccagggcactggggtcagaaggactggattcctgcttcaacatggccacgcattacctgggcggccctgggaaggtcactcgcctctgcctgtttataaggtcagatgagtagaacatgggaacgtcccttggtgcactatgaaatactctcccaacacagggatggacaggatggtgatgctcacggtgacatttggcaccttgagtgggtagaaactccactgcccctgggtcagtgtccttccagactcagtgagctgtgtttgaacctgagagtggagatcaaaagacaaaagggatattgctggtaggaatgtgcagcagccactgagtaaacagtccagccactcctcaaaaagttaagcatagagttaaccacgtgacccagcaattctctgggtcttcccaaaagaatggaaaacagactcaggcaaacacttgtacgtgattgtccctagcagcattagccacatagtcaagagatgggaatagcctgaatgtacatcagctagtgaatggataaacaaaacatggtatatttagatagccttaaagaagaataaagtacctacgcatggtgcgatatggattgtgttagtctgtttgcatataaatacctggccgggcacggtggctcttgcctgtaatcctaacactttgggaagccgaggccggtggattgcctgagctcaggagttcaagaccagcctggtcaacacagggaaaccctgtctctactaaaatacaaaaaaattagccaggtgtgatggtatgcacctctagtcccagctactcaggaggctgaggcagaagagttgcttatacctgggaggcagaggttgcagtgagctgagattgcaccactggaatccaaactgggagacagatcaagtctccgtctcaaaaaaaaaaagaaagaaatacctgatacggggtaactcataaagacaagaggtttgcttggctcacagttctgcagactgtacaggaagcacagtgctggcatctgcttctggtgagggctcaggaagcttctgattgtggtggaaggcaactggaaggtggcgtgtcatgtggtaagacaggaagcaagagagagagggaggaggtgccaggatcttttaaacaaccagcttttgagggagctcatcgtgtaagaactcattactgtgaggacagcaccaagccattcctgagggatccacccccatgacccagtcatctccccctcagcccacctctaacaccagaggtcacatttcaacatgagattggaaggggacaaatatccaaaccatatcacggatgagcctcaaaagcgttttgctaagtgaaagaagtcagacacaaaagttcacatattgtaaggtttcatttatacgaaatgtccagaacaggcaaatccatagaaacagaaagtcagctggtggtggccaggggctgggggtaggagggggttctgggagcaactgcttagtgggcaatgtggtcctctctgggggtgatgaaatgctttggaactagatagaaggaatagttgtaccatattgtgaatgtactaaatgccaatcagttatacactttaaaatggggaattttatgttatgtgagtttcgccttgattttttcaaaagggaggaaaagaaggggtgcttgtggccactgccaagaagagaggagtaatccagtgaggactgggctttacgcagattcccacctggccatcccagtagccctgtgatggacctgttcatattaatacttccattctactggtgaggagcctggggctcctgcccaggcttgtgtgggttgtgagtggcggcgctgggcttgaaggcgaggtccgtggctgtcttgtgcagtccttgccgcaggcctgccgctctgctgcttgccttgtagcaatcgtctcatctaattttcacaagccgtgcagcaggtgctgtctctgtgttataaagggcatgggtggaccggggggttacagccaccctggtgacaagtgatcagaggacaggaggtccctggcccagggccttgaaggaagacaagtcatgggtcacttgggaaggcacagaccgacagtaagaggctgtgacaaagcggctcagagggaacgcgggcttcgggagcaggcacatcgtgcggggctggagagcaatgggactgggtctgcagcgctgtgaggaagggagtccaggggaggaacagcacacgccaagcacagtgtgagccaagaacagggccccaggggactggaggcctggtcaggtgaaggagctgattggtagacaggcggaccaggtggacatggctagatcatggagggctcctgccaggtgccaacccccactcctgtgtcttctcggaggcaaaggccccttgtgccacctctggtggccaataggctggaacctgaacttgggatatggagggcagataagggtggggagggctattctatgggcaggccgagcgggcagcctgggactctggctcagctgtcagtcccagaagaggggtctgaggaattccaggaagcgaggggaggaaccagccccactgcccctgcctcagaatcccccaggcggacgtcccagcaccaggaagtgagtaactgcctctccagacctgcagacgacagccccgctgccaaggatagaattaggaagagtggccaggccgactgccaggctgagggctacttcccgccaaacctgggaacccaccgtcacctcccagggcagcagagggatagacggacagaggaaggactggcctcttcttcaccttgcccccacctcaggtccctctccatctcacttctggaggtttttgcaccaggaatagccaggactttgcttgctttaagcgtttatttcttccaaacgcatttcataaacccttcagaggactttgcatattttcttaacactaaggacctctatttataagacaccagctttcaagggaaagaataattgcagattaaatctacccacttcaatttcttaagtgttagagtggagaaaagtctctgagttggggaagtccctgccaagccctgggtgaggaactgggcattccctctctcccttgtttgcccagcaacccccagaggtggagggtagggctcacttctccagagtctcgtcactccaagtctctctgctggaagcagtggtgcccggttcagagacactcaaagtgagtccaaggcgttccatccagaggccacgctttccattcaaaccaggacttgcttcaaaggcagaaagaaggcagcggcgttctaacagataccaaggcaagagacccggtcacatccttccttactggtgttgtttccctacattggccaaccacacccaccgaaaaggggagggcagggccccagagttcctgctcctttgagtccccccactccctgtgagaggaaggtagagagtgctgatgaaacgtgcacataccaagaagtgaaaggaaaacagatgagcttgttttctgcagtgtttctgcaagctgtgaaataggcacaattctggtggttttaaataagagctaaatgcactggtttttgtgcttataactggcattgagtgatatcaaggtgaatggtaaatgcatgctaataatttaacgttttaatttttctatactctcaaggtgaatggtaaatgcatgctaataatttaacgttttaatttttctatacttagaacaacattaaacagcaaattttaaaaacaccatgacaggccaggagcagtggctcactcctgcaatcccagcattttgggaggctgaaggcagggagatcacttgaggtcaggagtttgagaccagcctggccaacagggtgaaacctcatctctaccaaaaatacaaaaattagctgggcatggtggcacacacttgtaattccagctactcgggaggctgaggcaagagatttgcttgaacccgggaggtggaggttacagtgagccaagatcacaccacaccactgccctccagcctgggggagcaacagagtgagacttggtctcaaaataacaaaacaacaacaacaacaaaaaagaacacttgtcatgacaagtcaaaagagagaccacagaagaaaggaaaaagccttatggcttaatacctttaccaacacttctttcctgctttttgaggaatgggcccatttttcactttgtacggagtcccacaaattctgtagttggcctgcctgtcatacgtttccgtgaatgctaaggaaaggatggtggctggaggcggagctgtgcaagaagaaacagcaatacaaaagggggaaattcggccgggcgcagtggctcacgcctgtaatcccagcacttcgggaggctgaggagggcggatcacgaggtcaggagatcgagaccatcccggctaccacggagaaaccccgtctctactaaaaatacaaaaaattagctgggcatggtggcgggcacctgtagtcccagctactcgggaggctgaggcaggagaatcgcttgaacccgggaggcggagcttgcagtgagccgagatcgtgtcaccgcactccagcctgggggacagagcgagactccgtctcaaaaaaaaataaaggggggggcggaattccgcttacaacaacagcatacataatatgatcctgttcatgtaaagtgggatatattgaagtacggacatatataacactatataatgaatatatgtaaacacacagaaacatggcatcaaattctttttttttttttttttttaatttgagacacagtttcattctgtcactcaggctgaagtgcagtggcgcaatctcggctcactgcaacatccgcctcctgggttcaagggattcttctgcctcagcctcccaagtagctgggattacaggctcctgccaccacacctggctaattttgtattttttagtagagacagggttttaccatgttggccaggctggtctcaaacccctgacctcaagtgatccacccgcctggacttccaaagtgctgggactacaggcgtgagccaccgcgcccagctggcatcaaattcttaatcatctccaagctgtacacttttcagttgattttcactttttatcatacacattaagttcaaataatagagaaacaatacatccatattatgtatatgatcagctgtttttttttgttttttttgttttttgagacagagtctcactctgttgcccaggcgagactgcagtggtgcaatttcggcttactgcaacctccacctcccaggttcaagtgattctcctgcctcagcctcctgagtaactggcattacagatgtgtgccaccatgcctggctcatttttgtattttttagtagagacggggttttgctatgttggccaggctgatctcgaactcctgacctcagatgatccgcctgcctcggcctcccaaagtgctgggattacaggcgcgagccactgcacccagccatgaccagcttttttaaaaagctgcattttcatttggggaaggggaagacatgccgatggagtcagacttggactcagctcttggctctgctgtttccactgtgcaggatttaggccaagttaagtaactcctctcagcctctgattctccatctgtaaaatggggatactgactggtaaccatctcatcaggctgttgtgaagggtcgtgtgcttacgtagggcctgctacagagatcacttggcagcgagtcgccatgcggggctagggctggggggctcatgcctgtgccagaggacagtgcccccacaggctgtgcaggaggcctctgggaagggaggccagaggcagagaaggcaggccagagatggcacgcatgggcacatgggctgggaggcgcattggggacgcagaggctctctagagttcttagctgtgagtgttagtgccaatcaggcaaaactacaggctctgcatgggttttgccatgaacccaaatcagcacttatcctctgaccctgctttccagtttccctgctggtctgtctgacctgtgtgtaactggtcagccttttgcagggcggctgctgattcacagaggaccagggagtgcctttctggtcagcactgtggcattctggacaaaagcacagcccgctcctggaggccgacgaatagaataatggccttcccgggaggacctgtgccttacacacagacatgtggagagaaagatctggaacattggggtggagggtggactttcataaacaaacatgtacacacatgtctacagcccgcttttatgctgttctgtttggcctggtctttccttcatcccagtaaggttggatctgggcacttttccctatagactgcttgtactccttgcagagggcacctcctatgtgccgggtgataaatagcaataagtaagacggggtccttgcctcgtggtgttctcagaccaccaagaacagttccggggtgtgttagaaaacaggcatgcaagaggtgcggacaagaccaggggcttcaggaaaggcccccaggcagcctcccaagagaagagcaggcttgattcaagcgagggcgagaaagggcatttcaggcagagattgccacatcaaaggccccgggtcaagtgcaatcctgccccactcaggagtgcgaggggggtctgtggggctaaagtacagagggctggccgtggctggggaggctgcagtggccggggaggagacagcaggaggaacagcttcttatcgtgccatgtgaaagagccctgcttagtggggcagggttttgccaaaataactggatccctcctgtggtccttgctgaacgcagttgggctgactcgaacctggaggctttacagggctgagccaccccctgcagaccccagccaaggagactgagtggtgaggagtgtgatgaggctgccgctgcagggactttgcaggggcgttgagacaaaccttctcatagcaaaaatgcagtacaaaagtgtgccactccagacataaactgggtgctactgagtcctcaaggaacactttgaaatcctccgcctggctctgcccataggcaggggactggcctcagggtaaactcctccgaggcacggggatgtctgaggcatggggatgactgattcattcacttctgcttgacaatgcactgcctggctatgtgggtatctgataaatgagtgtgtgggtggatggatggagggagggagggagggaggcagtgagagagggagggatggactgatggatggacagacagacggatggatggatggacggatggacggacagatggatggatggatggatggttggatggatagacggatggacagacagacaggcgaataagtaaatgaatggttggataggtggataggcaggtgggcggatgtgtgggtagataccagtgtagatgaatggaagagtgtgtaattgttttataagattaaaatattcttttgatggcaggacacaacacagtgacactcagataaatgaaaggtagaacttttgtttcttacagctccaaatgagaggctgtcaggctgggccacacaggatgtgcaactggggacagggtccaagcaagctggagctataggcggcagctatgtgtggcacgtagggtggtgttaacgaggtttccttggctccctatggattggctaacttaaataagtttgtgagttccagatgatgggagctgtccattattgtttggtacctggctccaaggccatcagggcaggtggctagtggcccagagtgtgagaacctggtaagagaaagggccagaatgtgaacttaatcagctgctcatgaactggctggcctccagccaggacctcaaaactggtttaaagtagcctttttaaaaaactatatgacagagatggatggagatgtgtgcagatggacagatgtcttttagagatttctgtcaatgatatttacagaagcatcaacattggattcagatccttgaggattttcaactcatagatacagagctctacaatatctaagttggaagagacttcagagggtctctggacgctcatgcaggtctcaatatgttgtggatctcagagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgcccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcggagggggaagtgcccaggaggctgatgacatcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggaggggaggtctgacaggcgatggggagaagggttcccagcaggaggaatcgccctgtttgtctgttgtaggtttctcttctctgaatcaaggtgacagacaggcttgtgtgtgtccagtgtgtgagggatttcgtgattggattttcacatactttgagtggacaccttggagtaaggcagcgaggtgtgtgtggtgcagcagggacgggtgctgggtggaggctccagaacctggcttttcacccacagctgtgccactccttggccctgtgtgaccctggacaagctattcaacctctctgagcctcagtttctctgtctgcaaagcagccagctcgctggctccctgggggtggcagggttaaatcagaagcaggcgggggtgggggggtttgtgaatgttggctgatgcgcctccaggaggcaggtggtagtgactacctcagatgggcttagagaccctcttcccacggtcctggctgaccagggcagggggataggatggtgcaggggttccaagcaccggctttgcatccggcccaggttgcagctccagccctgctctcaccctgtgggtgacgtttttgggcgagttattttgtcctgtctcctgagctataaagaagacctggaagttcctctttatgcaaagatagaggtaggctcttgcctgtgaagcaccacgtatgtcataggcactaaataaatggcagccgtgattcgagttgctgagagtaggtcgtttccgcagcctgggtggaggtgaacagcaggtgttgctgttccaggcaggtcagaatgtgcctcactgagtcacaggccgcctgtggctccccagcctacaggaagtgggagccctggcctgggtgtggggtgatgggggcctccctggccaaccccgcccctaattccatttctgagttggagaagggcttaggtggtgggggaacaggtaagcaaccccagaggacattgcaaagaggccctgcccgaggttctctggagaaaaaactgtgctgcgtccttcgggccctggcagcagcaagagacattccacagttgtgagccccacaagcttggaggaagcatttgctgtttcccctgcttggggtgagagcaggggacagccaagagaaggcgtctttggatgaaaaagaggaagcatgcgtgctgtccccacaggcagcaccccaggcctcatcccagctctccctgcaaccctgcactccaagcctctcactgcactgatgaggaaactgagtctcagagggggaacatgacctcagccagcccttcgctcagtgtccagggaaatgcctcaatctctttgggattccctcccttgcaaacggggaggttcccatggttgggcctgcatgatggatctgaggactttgaaagtggtatttgcctgccggtgggacccaacctggaaatattaggttggtgcaaaagtcatctcggttcttgccattagaagtaatgccaaaaaccgcaatgacttttgcaccaaccgaatagctgtgccacgtggtttttgctaacacagtgactggctcagtaacaagtttggtggctccagaggtaacattagggcggcctcctcacctgtgctgcttgtggtcagggaggggcccacctgggcgcggtggggggagccctgcagatttgcccagtgtcatagcctgtttgagctgctataagaaatactttagactgggtaatttatcaaaaaacagacatttattgctctcggtgctggaggctgggaagcccgagatcaaggcactggcagattgggtgtctggtgaggacctagtcgtcatagatggcaccttctatgcatcctcatatggtggaagggtgaacacgctctcccaggcctcctttaaagaccaccaatcccattcacaaggagggggacctcatgatctaatctccccccagaagtctcaccttttaatatcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagtaaaaaataaaaaaaatcagtggttgccaggaattaggggagggaggagagaatgggaggagcccagagacttttagggcagtgaaacttctgtatgacactgtaatggtagaggcatgtcattgtgcgtttgtgcaaacccacagaatgtccatcaccaagagtgaaccctgatgaaaactatggactttgggtgatgatgatgtgtcaacgcaggttcatcaattacaacaaattgactgctcttgtgggggatgtcagtaacgggggaggctacgtatgtgtaggcacaggggatatatggtaagtctccgtactttctgctcaattttgctgtgaatctaaaactgctctttaaaaaaaaaaaggcacacagagcagatctgcatgttgttttgaggattcagaaggcacttaggacaattacggtacctcagggtcatgagtcaaacaatcagacctgccaagacttgacaccccaaatgcatcacttctgacatccattgggtccaggaatcccctgcctcatgaatatccatcttagtgtgcatgcctccaagaatggggagctcactactttgcgaggcagcgcattccatcttaggagagttctactgtttaaaagctcttcctccaactgcccccactgagcaatgggtccactttcatttccttggggtttgtaccattctagtcctattgcttctctctgagctaaatatccacagctactaaatctgccccccttgaaaagtgttaaatcctcaattcctcctctgagctcctctggttttcctggggacctaaggctctgcttccccaaaacacccactccagggttgttttctagaacaaacgtaaggcatgaagtatttctttgactctttcatcacagtgggttctggaagattctggaggctggaaacatatgtgcctccccctccccacacacattccaaaaaagtcatcacagcagaaagcacggtggaacaaacagctctcggttcgaattcaccgtcacttactggccaggaaagttatctgagcctcagtttcttctcctgtacaatggggagcatcattcctatttttgaggaccactaggaggcttacctctgtttgtgctgatgtagtgaaaggggatgtcaggcacactgcaggagctcaggtaccagacggactgtctatggaggcaggagtgagggcctggggcggtcacagaggttgcatttgctttgcagtaaggccatggccgcttaagggtgtccagaaaaaagccctgtccgacatgcacacactcctgtgtccaggcaatgagcctgtgggcactgacagcaagagtccttctcacgcttctcttcagggctcaaactttagatttactccggcctgtcccatcccattcactgccaacccctctgagcctctctgatctgtgccaccggtgaagggcagtcgtggggcacagagaagtggcccagctgagtgacatctggaaatgagcagtgcctgaggggacgcccgtggggtgttgtgacctgtacagtgccaggctccagcacagccccgtcgcttctgtggttcttatcatggtcatgaggtcgcttctcctcttccctgcgggtttcctaagtggtcacactccagtggcagggtggtctgccggagaaagaccaaaatttgtcatactttagaatcacctggagactggtcacccacgcaggtgcgggggtcctgctctggggactgtgatttgaagtctgggtactattcactgaaatgacagactgcggcaaatctcaatcaatcaaggttcatcgagttgataaacttcaattgacatttatcgagagtttgagggtgcacctgggaaaaacatgagccacagaaaatgtgtgtggcctatgctctccgaagagtcatgagacttagtgttgtaaatcaaagagaaactgactgaagcaggtctcaattatttttgaagtttattttgccaagattaaggatgcacccaggaaagagggacacgaaatcacaggaaacatctctggcccatgcttctttcaaagaagggtcttcactattcaaagggaaaaaagcaggcagtaggggaaagaaggaaaaatcgggggaaggtggccaaaagaggcaagcagttgcacccctttgagccttttcattaacttcactgaatgcacatttttcatgtgaaagaagcaggtggaggaatcatcaattccgcattcacctggtgctcagtcaatctgcatttttatataagataaaataatcatagggctgggcacggtagctcacaactgtaatcccagcagcttgggaggccaagttgtgtggatcacctgaggtcaagagttcgagaccagcctgtccaacatggtgaaaccctgtctctactaaaaatacaaaaactagccaggcacggtggtgcatgcctgtagtcctagctacttgggaagctgaggcaggagaatcatttgaactcaggaggcagaggttgcagggagctgagatcacaccactgcactccaggctgggtgacagagcaagactctatctcaaaataataataataataataatcatcatcatcatcatcatagcatataggaagctgtcagctatgcactcgtctcaggtgagcagagggatgactttgggttctatcctttgttccatacctgtgaagctaagctgttaatttatatcatgagggtgaaatacaacagagctgcttgaaggcaaagatcctggggcccacaaggaatttcactgtgagcaaaatgtgagggaagtaaatagttatccatttagacacaaaacgggaggcgggttgcatgacccagctcccagctagacttttccctttggcttagtgcgtttggggtctggggattttaattttatttttctttcacagtatttacacatgtccttgaagtggagaaagcatgtaggaagaggaggttaggcagaaggaggcctgatctcatcttgcctttgtcttgcttttatgctgtacctggggagatcagcaccatcagcgtgactctaacagacttgagtgtgaggagctaggcttggattgcagacctcaagttacaattgatgtgtccttgttttgtggtaagatccacatcttgaaaggtttcacccagcaaagaacaatttgtgggggcagtcatggggagatatccgaggccttttcctttctgtgggggtctggctaatgtctaaggttgtggagtaacagctgtcattaggaataaggatgacaatgttggctgactcagtctccaggcttaactttccctttggcataaagagtttgggggtcccaagatttctgttttcctttacagtactcaaggacttgctaatatctcaggggatttcagccacactttgaaacaagctaccttagcaaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctcctttcaaggtagatttgggcccaaacatttcgggaagcatcaggctgtgccccgccatccctaccaaacaggaatcctctcgagggaaaagactgggcctttccctcagcccctagcacccactcatgcttggcacctgctgtgctctaagagtgcaggggtcactccctgaccacagagggaggctctctggggttctcccggagcctcggagattgcaccttgtgcatgcgctgctgcacctggggtacatcacccccactctggagcccactggccggttagcaaagtgagaggtgagagaaggacctcttggtcttctttgaacagaaagatccagaaagcaatggctagaacacaagaacaggtcaggggaggcaggagagggtctgcacacctgctacaggtgtgctcacacgtgggccagggcctgcagatgagggatctgtgctgatcatttgtgatagccaaaagtagtgaaaacctggggggactcctcaaatgaactgtagcacattggggagatggactctgtgaagatgattcctctctccacccacttcccttctccctcctcctcccgctcctcctttttcggaagccaggcacagggattgaatcccaccccattcctcccctgctgtgtgacctagggcaagagatgtggtctctgggatccttcggttccttcagctataaatagtagtagaattgcaaactacctacgaaaactgggaactccctgcgaaggccggtgcattacagggcagtcctactctgaaatactgtgaggctattgaaaagcaaggtgggtcgacagattgttaaatgcaaagaggtgaggacacagccggcggtgcatttagggtgcttctgcaggcgtccttatacatggatatgtgcacatctgctcctgaaagctcagaagatgtctggaaagcaacaggagacaccagtgagcctggctgtctcttgaggcaacaggcagggacagaatctggagggagacctacccctcactgtattctttttcgcactctgaaatgttaccatgaggatgcatatctctttgcaaaaatttaaatataaaaagcaaaacaaacttgaatagaaataaactacttgaaaattttagaaaacactgttacatcaaagagacagatcatcaaaactgaaattatagatatttgagaaacaactaactataagaacactgcttaccaaacttatgggatgcagccaaagccatagtcaggggatgagtcatgcctttaaatttttaaattattaaaccaaaaagattgcaaaaaaaaactgttcaattcaataaactagataataatgatccaaaaaagtagaagaaagaaaagaattacaaaaacaaaatgacaagttagaaaggtaaaaagcattaatgtcagtaggccatctaaggatggctctttgaagagcagacaggagaagggcaatcccaggaagtgctatgtgctatgcagagaattagaataagttgatggcagagatcagtgggtggcggctcacttgggtggtaaagagtagcctgcagccaaagttgggcacagcagtgcagtcttcactgggggaatgcctgggaaacaagatttgcctgggtaggagtttccatcagcacccccagaaaggtctcctttctaccctggcccccagttctttgatgggttttgctgatgctcctgtgtctctgaacagcaggcgcctcacctatagaaaggtaggatagcaggagttaacgccccctcccccattccatggcccctgcctgggattctaccatctctgcttcatatgctttataggagttcggtctgagcccacaacccaaacaggctcacagatgtgctagctatttcgccaccagtatttttttaatagtcaatatttagaaattggcaccaactggcccgattgttcaacagtcctgggttaggttactaggccaattacttgctgagtaacccaggacaggtcactgacctctccgaacctctcctttctcacctgtgtgataaagactactgctgtgccaacacaataggactgtgtatgaaagtacccagactgtgcctagactcaggaagctggtttattccttcctcccctaaccacttactgagagactgctcagggctcccctcagctcagagatctttccccacaaggagctgagagcctggtgggagagacaggcagagacccaagtggttctaacacagctctctgaatctgtaaccccaagtcccatccccagaggacactgggacagtcacactgatggtttgtccctaagcctccagcatcaggagccatgtggcaggatctccactcttcttcttcctgggcctctgtctggaccgacccaaacacacacacacacacacacacacacacacacacacacgtgtacacacacaagttgcttctttgctgcctgcatgtcctcacaccagcttatgacacacctacaatgtttgatgtgtcattgtgggcaggtttcaagttggaggacctagacctaggtaaagtagagggtctccctaagtaagggagggtgcacagtggagagaaagggtaggggagactgcccagtgccattgacatatgcctgagccccagggcacccttggccccccaaaacaatcacaagtatcccccccgacaaacctgccaagtaggcattgtgtctccacttgacagttgaggaaatggtccctagaggggagacagagctagctagagactgggctggccctggagcctggcctgggtcttcccatcgcatcctgcctccctacataagcaaaggtcgagaggtgggaactcccaaagatgctcaggcagggccaggggagaccagtggggcagggaggggacaggaggggaaggaggagctggggctggagagatgggtaggagcatgagtcccttgcctgggcctccccatggtgggcggtgatccaaaagccccagtcagagccctctgccctgtgacgggggcaccctgcatgtcccctcactccctgccctccagtccccgccagtcctcatgttttccatgaggatgagtacagccgcagggactttccctgcaagtggtctgggccatatcttccgggagtctgtttggactgtggtgtctgtggctgagggggtggaggtgagggcacccaggcccatcacttgacagaacaatctgtggatttgggggaaagaggaggcgactgtcattcctgagagaggacgggaaccaacaggaaggattcctgagtgccagggatgaccacactggatcctcacaacagccctcctgccggggacaatgctccttatcccacaagcggggacctgggctctgacaggaggccacacacttacagtccctcccttagtgaccggcagagctgggatttgaacacccctggtgagactccctcgtccagaccccttcgttgtacagcaggtttgcctcacatgccagagtcggggtggcctcagggcacagccaggagatgtccccaaatcccgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatggaaaagagaaaaagaaaatactataagcatccagattgactggaggttggggagttggtgggggcggggacaggcaatccataaagcaagaaaaatcaggctgggttcaggcttttctgcagcagcgaatgcatcagagctgccaggggggcagctgtagacctaagagagttcctttaagcacaaattggctgattatcttttttacgtaaataaacccataattcattccaaacacttggcttatttaaatatttttattgccaaaggaatatatgttcttcacagaaaacttggataccatgacaaacagtaaagaaaacccaaaagcaacctatgatcccatgctcaaagacaaccagcgccagtaataatttggtattttgccttctcaacttttgaactttgttgtatgtacaatttggttacccagctttttgttcccctaacatgttatcagaaacattctctcatttttggtgaactcttagaagcatccttttttcatgtctgcttgacatttgttgaatggatataagatcatgtatttaaccaactgcctggtcctaaacatttaggttgtttcctgtgacccttcttctgcatgatgaggaacatctctgtgcataaagcttttcctgtccttttgattattttcaaaaatgccaaacaaaaaaaaaagggagggggttgaaggttctgggttttcttcactgaattatccaaatattaaatgatctagagacaggtttgggagccactaaaccctctcctcctgtctgaccctattcagagaagacattggaagctgccatctgctttcctctcacagtctgtaagtggctcattaaatacttgcaaactagattatttttatgttgtcttggctacaggagtttctgcaggaatcagaaacaggaagaaaaggcaggtccttggagacagaggagctggcatctcatcagatgcaatttcttattaatagtcatccctaacattgattcggcatctactaataatcaatcccttcttacagataaggaaactgagtagcaataatctatcccatcttacagataaggaaactgagactcagagaggttaagggcactgcagtaagcgcagacacagagctatgactcccgttctccctgtgtcagcccctgcgcagtgcgagtgggaggtgagccactgttgcgtgccctctgccagacacaggcctgcaggtcagactcacaggagccaagcagagcatctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtgccttagtcactgcctcgggccaggttgcaagacccctcctaccaactgagctacaaatcacagttcctggagggtgggcctttatataacagggaacagaactcttctgtacctcccacctccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttggaaggatgaggtgggaggatcgcttgaacccggtgggtagaggctatggtgagttataattgtaccactgcactccagcctgggcaacagagcaagatcctgtttcaacaaaagaaaaagaagagagaagaggaagaaagaaggaggagaagaggaagaagaaggaggaggaggaggaaggaggaggaaggaggaggaagaggaaggaggaggaggaaggaggaggaggaggaaggaggaggaggaggaggaaggaggaggaggaggaggaggaggaagtaggagaagaagaaggaggaggaggaggaggagatcctacagcactgtttggaagattatgggaaaattaggcccacacatctgatatacaatcggcacatcctacaaatgtaaaatgtgtgtcttgaaccagaaagcccaaggagtgaggggctgtggcattgagtggggtagctatacatagccctagggcttaaatctatagaatttaagtaatcctggtccaaattcaccagaaacattgcctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccaggttcagagaggtgaagtggggggctgggggtctatcccagaccttgttgtcacctcctcactctcccagtagcgccagccagagcacctgtcttgggagccccgaggcagggacaggctatgcatccaggaagcccccaggctctaaggaggcggccctataactgctggatgaccaaaaatcaggcagcgatccctaagtcccttctgagccccaggctccagactcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagacgggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacctccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatctccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaagcctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcagcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccaacttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacttccctgcgttcaccaactcggaagctctcccaatcctgtcttttagggattttgatggaggcttcatcatataggcatgatggataataaattcaatctccagcccctcttcccttcctggaggatgtggggtgaaagttccaagctttgtatcatggcctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcaatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtaaggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctgttacatcccctcattctcccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctggggtatgaggtcttggttttgacaatcagacaatgttagcacactgctgtgtcttccacctgcaatggagcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcggaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacacatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggacggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagaagttgccattcactgatggctaagtgttaaccaactcagtggagagtgagggtgacagccttttacaccctgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtataggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaaattaaattaaaaaggattggtggctcacgcctgtaatcccagcactttgggaggccgaggcaggtggatcatgaggtcaggagatcaagaccatcctggctaacacggtgaaaccctgtctcttctaaaaatacaaaaaaaaaaaattagccaggtgtggtggcgggcgcctgtagtaccaactactcgggaggctgaggcaggagaatggcgtgaacccgggaggcagagcttgcagtgagccgagatcatgccactgcactccagcctgggctacagagcgagactccgtctcaacaaaaaaaaaaaattaaaaaggattggaataaaggaatggtttagtaaacaaaaataaacaaatgcaatgccttttttgaaggcgtcattactacagccatgatggagcaacacggataaattcccatgacaggaggtttcatgtaaaaccacggtgacagaacatagttggatgtggcatacataaacagctgtgcccagggatggaactctgggagattttcccattagttttaaatgctctttcatgtagttattcttttatttttatgtttttgagacggagtctcgctctgtcgcccaggctggagtgcaacggtgcgatctcggctcactgcaacctctgcctcctgggttcaagtgattctcccgcctcagccccccaagtagctgggattataggcgcccgccaccacacccagctaatttttatatttttagtagagacggggcttaatattagttttaaatgctctttgctgtagtttttttttttttttgagatggagtctcgctccgtcacctaggttggagtgcaacggtgggatctcagctcactgcaacctctgcctcccggttcaagcgattctcctgcctcagccccccaagtagctgggattataggcacccaccatcatgcccagctaatttttgtatttttgtagaagtgaggtttcaccatgttggccaggcttgtcttgaacttctgacctcaggtgatccacctgccttggcctcccaaagtgctgggattacaggcgtgagccacagcacccagcctagttatttatttatttattttttttttaaagagagagatgttattttttttaaggggaatgagtggtattaggatgtcaaatgaaattgcttatttaataaaactgaaaagcccagtttggggaaagaaacaaaacacactgagcagaataatctaaccacagtgaacaggaaaaaaagccaagaataaaataagttccggggtatccaagggtgagcaaagccaggccggcaggcctcctcctcccttgcagaaagcaggatggatgaggggctctgcttctccaggctccctcatgtccccactgaaagtgtttccagaacattccaggcccataaagtgtccaaatgctggaaggacttacatgtatatgtctgggattgaatcaaatcttctgactcaattctctttgggagttctgagaatggaggtcacttcccagaaccccgtcttccccctacagacagctttggccttcttttcagggaagaaaagaaaagggactcttggaaaccctgctgagggccacgcagctctggttgttgaggctcatatggtttatgaggcgccatcacccccttccgccaccccctgcctgctgtggcctgaggcttaccttcgtgactgccctaaaaacagcatccagactcagtaaccacgtcaatcagcttttagaggaaaacatttattctggggaggtgtcagggaaaggattcaggagatcttggttctttctagctctggccttgacatcgacttgctgggtggtctgaaggatttcacttatttacagagcgaatattgttcaagagtttgggatgtgcaaaactcagctgcaggcgtgatgcagggtgggaagatgagcaaggcagggtcctcctctccaagtacagcgaatatggtgggacagatgcacatgcactttatgcacgcatgcacgcacaccatgtgctcagctgccactgagaggagataggagatgcagagggagagggagaacagccgccctctgactaaggatggagcccagctgtctcaagagctctcctggatggacagactggtggcgtcccagcaaaatcccccatctctccatccggctgtgtaatgaatgactggaaacctcagctggcctgtgagcaggagatctggccaggtggaagggaatccctgacaccccacagcccctggtgtagctaaagcagacgggcctcctgggctggtgcaggaagaacagcttatgttctcgaacacattgaccacgtgctccatgcatctgacacacacggactcgtctactccacacagcaccctaggagatggggctgtttaaaataccaatccccactgtatagttgaaaaaaacgaggtgcaatgaggttaaataacgagctctagagaggaggactcaattcacagtcagcttccagagcccatcggcctaaccgccaggctggcttcccgtccgtaatgcacgtttccagctagaggctttcaggctgtgtttcccacacttagccattgacattcacgttcacagtttttgccacatccatgtcacctgtacaaccatttctttagtagtgacttacttttgaactgcaacttcatgtcaccaatttaaatggaaaatgagtatcacttatcataaaaaagatgataactgtacaaaataaaagcaatagaatgtgaacaatgctattagagcctgggtagattcggggaccagccaaggctctgaacctgctcagtctgttgaaaaaggagattacgcacatagaaaggcgttgaagtgcacggacaccacgctgagacgttcttgttggcctaatcaggaggaacgactagattattcaattcaaggttgtttaccaggccaaactacttcccttgctgggaaatgcttcccagctctaacgtgcagtcagaaaatacgggacacaagttgacatccgaaggaaaaatatcttttccttctccacttccgagttcttggttgggggccctgaaacaaaaaacagatgaacaagagaaaagtgaacaaattaatttaatgtaagtttaatgtgacatgggaaccttcataaggaaatgaagtgattaagcctgagtgcctttttgtttttttgagacagagtctcgctctatagcccaggctggagtgcagtggtgcgatacggctcactgcagcctcgatcaccccgggctcagctgatcctcccacctcagcctcccaggtagttaggaccaggactacaggtgtgtgccaccacgctcacctaattttttggtactttttgtagacacagtctcggctgtgttggccaggctggtctcccactcctgggctcaagcgatccgcctgcctcagcctcccaaagtgctggggtcacaggcatgaaccactgtgaccggcctgagtgtttccattagatgtcatgaacagtggagaatcatggggctgtggtgggaccagggggcacgagcgaagtacagagaactggagaaacagcaaggcctgtcggggctcctctcagtgtccccagtgctcggagtggacggtgcccctttcctctggctgtggagtctggtgtcctgcttcagggaacaatcacatagtccttctgcgcctgctgtttcttggattctttccacttaaaatattcaacatgcgaagctgccacattttggggtagcgtgccctgaatcattggctacaaggtcgcgggccccacatgaggcacagttggcccttgagacagtgacactatgtatttcgtggaggccactgcttcaaaggccctaaggtgtggattcctgggaaaccaaaacaggctgtctccaaggctcaagtggaattgatttctaacagcccaggcccacggtgtctgtgcgagtaaatgaagaaagtgtttttacagtaagtcttcttggatagaattctgagggagagagagaatgagtgaatcagaatgttggatgttccctctaaggcatctgtttaaaaaatcaggggaaaaacccaggagcagagtcatcacctgtccccagctctgaggatctgtgtctgtgaggcacatgagtccaccctcctagctctgtagacaaggaaactgtggtccagagagatggagatcccacagacaacggcccacctggagcaccccctccccgcctgactttatattcccaggatgcattcatcagggtctcagtaaaaaaaagagggcacattccaattgggtaataggaagaggatgttaatgaagcgtttctttacagtgctgtaggcagcatattggggttctgcgaagagcaggcagcaccctgggtgcctcagggctggtacggcaaagcctcagcaccctccctacctccttcccccctcgcgatcaggcccctgataaaagcagtgaactctgctccaggtctggccagcataaaggcccccaagagaggagccaacaacaccccatcctccctctcaccctccctcaggctcctgctggggctcccactggccaaacccaaagagaagccggaaggcaaagagctccgtggtacccatcagggctcccaagcaggggccacagaggagaagccaggaggtgacctggagcaggacacagcagctccctgacagggatcctcacccagggcacgcctctagagcagatggagaaaacaactcagtagacttcagactcccaaattctcccagttcctcaacccgcctgccctctggacttcgggagaaagttgagagggaaagccctcaactttgttttgaaaatgagagcaatgtttacagccactagcaagcaattaggatccagctgggctgatgtggccagatctggggacacccagccaggtagatgcacaacagacccataatggaggccagcgaggaaacgctggacacgtcccccatgactgagctgtgaggacctgacttatctgtgcggcggtcactgtcgtgtagaaatggaagctgtacatgcaggctgaggcttctcagctggacagttcagcccgagtgagccccaagaggacaggggaggctggtcttcattcttcccctctgaatcaccagcaaatgatagaccgtcaataatttgttaaatgctttttaaaatgaatgctttaagccgggtgcagtggctcacatctgtaatcccagcactttgggaggccgaggcgggtggattgtttgaggtcaggagttcgagaccaacctggccaacatggcaaaacctcatctctaccaaaaatacaaaaattagccaggcatggtggcaggcacctgtgatcccagctactcaggaggctgagacaggagaatcgcttgaacccgggaggcagaggttgcagtgagccaagattacgccattgtactccagcctgggtgacagagagagactccgtctcaaaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggatcagaaggactgtgctgctcgttgcatcctttgcaagttccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacctgcactcacacacttgcacatgcatagaccacagctttccacacccttcctagacaggggtcacttggtgtcctggagagagtgtgaagtctggaagggaaagaggggggattaagccccacctctagccatgggactgagacaagtcacccccacccatctgcgccttgtttcctcctctgtgaggcaagcacagagcccatgcctccctccctggatgggagtgatgtgaaacttgaagaggggtagagacaagggtcgtcaatggaagccccttgggcaaaaaggccctttcaactaggggcacagaggaggccctgggctgagaacttgacagcaccttgtattggtaaccagccggagggactggaaatactcagatgtgtctgtctcccttattaggttcaaagtccctcgagaccctgtctccatcacagtgctccagtccagacccctcctctgagctccagaccctgctggacccaacagccatccccatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatccatattcacaccaagcgccttcctgactgagatatcctcctgcaccatcatccctccaccctgtttagttctgctcaccctcagtgttctcatcaataatccactcgccctcacaggcgcgtttgggaccccatgttctatgctctcacaggaccttttgcttgatttttcactgtactcaggtcagtttgcagttattaagtgactgagcaatgtctggcttctccagtagactgtcagctcctagccattgtatccctagcaccgctgtgtgggagcacttcacaaacgtccattgagtcagggactcagcagtctccatttctcctccctgctggagaatgcgtgtattttgcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccagtgatgttaagcccaaagacaaaacctctcaggtgtccaagtccctgtaggcctgttgggagcagagggaatgttctgcggaactagaggaagaggggctcagggagaagaagggcacattcctggttgtcatatgtgatctatcccagatgaacttggaagtgaagggaagagagttaaacattaaagtaaatacccagtggatcagacagcaatgtgccagattgccttggagacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattaataagcagcatctggtgctatactttggtctctagtgagttagctcatgaaagatgacagactctccaagccaggggtatgcaggaaatgggttttctgtagctacagaaatggggttgagggttggaccaaggggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtcccgtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcagcttgaatgttgcaacagccatgaaaaaagaaatgcaaagcgattcaggatgagagcaataccctactccaaagaaggcaaaatagaagctcagagaggtcaagcattttgcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggcattttgcacattgtctctgatccctatcacaaccctgagaggtagtttttttaactcccattttacaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactggccaaggaaatatcccagtggagcctcgagatgaagaacatgaggcccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctataggaaaaaaagaattgattatgcatacccagtatgtatacttattaatctgtatgaagatgtacattctaaaatataatcaaccagtagaaatttaagaaagaagatgtaaaaaaaaaaaatattaacagtgcttgaatatttccttccatcttacatttctgcagggataactcattaccaagttcccactacatgaatgtgagaccctcatgaggcctagaatcataggcgcagcagcgattcaatcatttattcatgcaatatagacttactgagtgcctaccacttgacttcccttcaaatcaggagtatcttctacaatatcctgatgaaaagccacttgtttcatactcccagtgatggggaattcattatccatgccactttgggatcccttcattattcatgtattcattccttcactcatttattaaacaaaacttgcctagtctgtctccataaatgcccctcctccatccatgcatccatccatccatgccaggaacctggggctcatcgctcaacgtaccctctccttcatctgttccatctggtgggtcagcacctcttttatttttttctaacttttattttgagttcaggggtacacgtgcaggtttgttacatagataaacttgggtcatggtggtttgttgtacagattatttcatcacccaagcattaagcctactacccattagttatttttcctgctcctctccctcctcccaacccccaccctccactagacctcagtgtctgttgttcccttctttgtgtccatgtgttctcaccatttagctcccacttacaaatgagaacatgtggtatttggttttctgttcttgggttagttcgctaagaataatggcctccagctccatccatgtccccgcagaggacatgatctcattcttttttatggctgcatagtgttccatggttgtatatgtaccgcattttctttatccagtctataattgatgggcacttacattgactccatgcctttgccattgtgaatagtgctgcagtgagcactcatgtgcatgtgtatttatgatagaatgatttatattcctttgggtatatacccagtaataggatcagcacctcttttagattctactcactaagtgtttcctaaatctatgtttccttctatgtccaaccatcgtctgtcatgggtgcctccaatactaactactaccatctcccaattcttattcttcactctgcagccaacatggtcttttaagaatgcaaatacattcatggggaggctataaacatagagaactgtgttcaggagccaagactttaggattaggtagacctggattccacttgtggttcagccttgggctcttatttgctgtgtagtcttgggtacctcagttatcctttctgagtcaacatttccttgtctgcaaaatggggataataatggtatctacctcataaaattgttaataggattaatgtatgaaagcatctagcacagtgcctggtacatagttggcactgaacatgtactagctttgatgatgatgatgatgatgatgatgatgatgatggtggtggtgttggcagtgagtgtgatgggggcatcctccaagggaaacccttccatagtgtcccacccctcttgcgataaggttctacagctgtaacatggcttgcaagacccttcatgatctggtccctgtcttgtctctatgtctccctctctctgctccaggctcattctctaccctccagccatttggacacaagaacctagacagatcccagaagatatttcattctgcctccagtgcccactcttcccacccagactgcaccccctcactaagtgccctgaacttggaggaagttgtccacaagtgcccaagggagctcactcctccagggaattttgttcacagatgcctgcattactcaagggagtctgcaatccaggggaaaccacatgcctggaaacctgagcagggctcttagcaggcaaaaaaagaaaaaaaaaatgctgggagagcctccccagcgaggcaacaggagcagcccctcaactcctgaccctctctggctccagcaagctggcgcaatgagaagaagtccaggtgggctcaggagaccaggcaaggggcctagctcctgagtcttccctggccacagaggggtgagaataggatgcagagatgcaaactggacaccagatgacctcatgggaattcatgctagtgctggagcctcttgagcacagccttcatgactcagagggggagtgtctccattgtgtagatcccagccatgtgctgcattatctccttgttacccaattcctgacccttatgtagctctgatccttcaccaaggatgagggtggggagcagggatgagcaacagaggtcatgatttggcaacagcaatggctgaaagtttaatcgtttgttcatgagagttttattctggttttagttttttattttgttttgctggctgaggcaaaatagtcccaggtcaaagggaccccatcaaaatacttcacgctcacaaccactctgggagtttgcatgatcactggttcatggtatggaaactggggcccagagagggaagtaactttccaaggccatgcagttcttaaggagggtgctctggaaattctctctgttcttggggtgttcatgccttaacaaaccgaggatacaaattctgtcacaggaaaagtcctcgaagtgccttcttgcatgacgagcttatgacccagggcttgggctatttctgccacaataaaagctttgcatctcataggccttgtgcatacttgcttcctgcagatcaccttcccagagctggtggatgtaattcacatgccgtagagtttacccacttcagcttttacttaataaccaattcatgcaaccatcactactgtctaattccagaacactttcatcatcccccaagaaatcgcatattcattaacagtcacgtcccattctcccttcctcatggctttgggcaaccactaatctttctgtctctagatttacctgttgtgaaagaagccaggcacatgttgtaggatgctgtctctgtagagcctataacacatgccttttgtgtctagctccttttacctcctaacactgagctagaatgtttaattgttgggggagaattttggggaccagtccatgggttccctaccatgccacttgtgtgatctcagcaagccactttactcatcttccctcccaccacctttggccttagttttctcgtctgtcaagtggagagataataagtcatgactctaacaggtttctggcatgtagatcagtggtctcgaaggactgccttatgtgatgttgatgctgtcctctatagtttacgaaggccccagcaccaacagtacaggggcttggaggcaggttcctggttcacatcttacctctgccacttcccagctgtgggaatttgaagaaggtcagtgaatttctctgagtgtctcttttctcatctattaaatgaagatccaagtattgtgaagattcagtgagataaagatgttgtgatgagttgaagagtatccctccaccccaactcatgtccacatggaacttcagaatatgaccttatttgggaatagggtctttgcagaagtagttaaattaagatgaggttacacaggttgagcattcctaatccaaaaatctggaatcacaaatgcccccaaatccacaactttttgagcactgacatgatgctcaaaggacatgttattggaacattttagattttggatttctggattaaggatggtcagctagtatgtattctgcaaatactccaaaatccaaaaacattcaaaatgcaaaacacaaaaacttctggtcccaagcatttctggataagggatccccaacctgtactggactaaggtgacccttaaatccaataactggtgtccttataagaagaggagaaaaacacacagagacacagagagagatggaggcagagactggagcgatgcttccacaagccaagaaatgtgaaggattgcccagaatcaccagaagggaggaagaagcaaggagtggcttctccttcagaccctccaggaggaaccaacactgccagcaccttgattttggacttctggcctccagaactgtgagaggacaaatgttcattgtttaggccacttaggttttgatactttgtatggagccctgagcaaatggatacaggtattttagtctttttgagcacatactcaccatccagttgcccattaaggtacctgcaggccccttctctcaacaatgagagggcacactggatgtttttctcaggtctttttagggttagagatacttgttcgtgcagatttcctaagaaataataccaaatgccatcttactaaattgtagaggatttttttcaaatggaagatactgaggcctttcccatattgcgggccagcccaagcccccagagcgtgaatcatgggccccgggtgctgagtgtaaatgcccatccttgcggacctaggacctgggatctgctgattctttcttccttccccagaaccaaaaggcaggccaattcaaagagtctcagaccaggattcaaataaataaataaatggcctcagagcccagctcccagcttccagacagcccagccaccaaccccacccaggtgggaggctacttatagacaaccctgaaagatggtcaaagatggggttctgagactctctggatgcctcccttcatgctgagtcaccctttgccgtccactcagccggcgagcaatgagtgtctgtttcctctcttcagttctggccaagacagagcacggtgtgtgtgggccctcctcataatgacactaccatcgtcttgtgcaacagtaaaatgataaaatcaggaacagttactgtggggtgcctactaaaggccagttgcatcaccacattatcccatgtgattaccaaattctacaacatgctccactttacagactgaggctctggaaggtggaattgaaaatggtccagattctccaattgcacacaaaaaatgtgttgctttctaccataatttcccattaaattgtctctttcacaaaaaaaaaaaagaagaagaagaagaggaagaagaaaatggtccagattcaccttctcagcagtgacggagctagggtgtcaacgctgctgaggcagctccacaccgtacacctgcctgcctggacttccaaatcagaccttaaggaccagggacgggacttgtttttgcagtcagatttgctcactgtcttcctgacctccctaagtacagtagtccccccctttatccatggtttcaattacctgtggccaatataggtctgaaaatattaaatggaaaattccagaaaaaagcaattaatacgttttaaattatgcaccagtctgagcagtgtgatgaaacctcgccccgtcctgctttgtcccacctgggacatgagttgtccctttgtccaatgtacccatgctatataagctacccaccattactgtatagcaaaaagcatagtgttataaggtttggtactatctgcagtttcaggcatccactgggggtcttggaacgttttccccatgcctaagggggaactgctgtacagagcctcattcctttctgttttgaagaccactggatcctgttctgtttcttcatagaactcacaatcacgatcctgtacaggtttctctgttagtctgtctctatcccaagtctgtagcccccatgagggctgggacagtcaagaatgaccccaagtcttcaagaaaagttatggttatcttcagcaatttcagttcccctatactcagagttctgcagctcacagaagcaatttcagtttccctggatccggagttttgcatccccatcatggggaccaatatgatttatatgaaagataaatgctcacagcatcaactttataatatggtaatccaattccatctctttaaaacatcataaaggaactactggtttctaaggaaaacatcttattccatacccccattctttgctgtacacatggcttaattaggcatctaggctgattgaaaaatgatgaaagagcttttccatatggcacttgctgctagattaagaaagaaggtcataatactgagaaaagatgcatcaacatgtacatattcatcttatcctgggaacatctatacagcacgatactgacatttcccacacagttatttgatcctcacagcaactctcagaagcaggcaggaccagagcattccaggaccaccggccctgctctcttctggaagccctgcaggtgggctccacctgccgtgagcatttatctttagaatagatcatgcagttagagctataaaactccaagtacagggaaatggaaattgcttccatgagctgcaaaactttatgcacctgctctctcaaaacacccttactctgggctaaaactatcattcaattctcttccctgaaccaaaccaagagctgcacagggcctgctggagggtaggggatatgggatattcatggatagcgtgagtaagtggggtgtggggcttgaacctgggctttctgaccccaagttccaagtgagccttccacaaaggcttatgaacatgtgtgcgttataatacaaatgctggtccccccacctgcgatggttttctcagcttgcttgccttccaaactcctattcagccctgaaaacctagtttaaataatcccctgccatgaattcttccccaactctgcataatagtcgaggttctctagagaaacataaccaacagaaaatagataaatatagatagatttgttataaggaattggtttatgcaattatggaggctgagaagtcccaccatctgctgtctgcaagctggagacccaggaggaccagtgatgtagttccagtgggattgtgaaggccagagacccaggatggccagcgagaaggtgggagaagacagatgtcccagcttgaaaacagccaggcggagagaaccaattctcccttgctgctccttttggttgtattcaggcctccgacaggttggatgccacccaccatgtcagggaagacaatctgccttactcagtctaccaattcaaacattaatcattcaaattaacctaggaaggttaaactcgctcacggcccccccagaaaccatgtttaaccaaatatctgggcaccccatggcccagtcagcatgacacataaattacccatcccactccacctcgagcagaactcatttttttcaaacctcacactcagacacagcctcagaacttcattgccactctgctttctacaacatgttgtcactggatgtcagcttgtccctgtcctcagccatcccaagagctccttaagtgggcacggagtgggctgtgttcgtctatgcaccccctgtgcccacacagggcctggcccccacaaggggtttggcacatgtttgttgacataagacaagctattgctattatatacttatttgtaatacatagttatgaatacactcagcaaatatttgagcacgtgctacttatcagccctgttgtacaagttgggaagatgaacctaatcaaaagagataaatccgttgcctggtggagcaggtggcaatagggctgtgaagagcagtggagcaggccaagaggaggagaggttatttcaggaaaggtctctctgacaagggaggattggtgaggaccagaaggacctgggggagcaagcatggggctctcgatgggaaggtgctccatgtaggggaacggacagtgcaaaggccctgaggtgggagaggaggtggtacattcaaaacagagaggaaaggctgggcatagtggggagtgcctgtaatcccagcattttgggaggccgaggtgggaggatggcttgggcccccaggaatttgagaccagcctaggcgacatagtgagaccttgtgtcaaaaaacaaaaaacacagctcgaggaagccagggcagccaggcaccatgagacgagtgctctgggaggcggctgggtctgtgcatgtgccctgggagacagctgggtttgcgcgtgtgctctgggaggcagctgggtctgcgcatgtgctctgggagacagctgggtctacgcatgtgctctgggggacagctgggtctgcgcatgtgcaaccttgccgccgtaaggtctctgttttcctgggcctgagacagcagcagaggagttcgagaagagacatgagacggcctggcttcggctttaggagacagagaaatgcagctgattttcctggtacaagccccttctgagagcatgtgcactcctgggattctcgaggctccctaaagaggaaggtctcgtgatcccctgctctgcctgggcgagaaggctttcatctcccaaagcagggccacacaagggcggggaggaacccctggcccagtggagctttatctgctaagtgggcaccttcccaccccagagccagcacccaggacccttcacttctgggctggctgccaggccatggcagcacctggagctgcctgaatgcccaggacgtgctcatgtccaccctgtcatcctgtagatctccaagtgtttgtgctttgctaaatgtatatttgggattttctgcttacctccccccttacacttagacaccgtctgttcaccccatccattccccgcttcctatgtgctagacacgcatgctcttctagggtggcatttgcctggcaccagctgggtgctccatatgtgtttttaaaataaaggggaaagcactcaggccccgtgcttagagaaaagcagaggattacaccaggacttgagtgatggatgaacactgaacagtgcgaggaggaggaggtcattttcagcaaatgctcacaagcaggatgcattcagagcccatgagtcactcgctcagcatggagggtggctctgggtgttacagcaagaccgttggggagctcttgaattccaaggggttgggtcgttgtcctgtggcatgacaaaatccaggtgtttccagaatattaatccagcagaaggatagactgaaggaaaggaatcagaaagccaggagattggtttacagtcctttgttgcagacttgtatgtacgttgcatgagtttctaaaccctgtgatgggaagaaaggtgtgaccgccaacagccttggtcgggggtgaaaggacacgagctggaccacagtgagggtgctgcatttcatcctggcaagaattctgcccagctgtggctttctgtcctccgtctacaattgggagaatactggagacatcagatgtcgtgtaaggactaagaacgaaccctggagaggctcagcatctgggtgctatttgtagaggtctgctgggtgacatgtactagagtctttcattttgaagaacctgctggatatgactagaaaagtaaaggagaaaaaaactccaggactgatggatgagagaactgaaaagtggcccttgatgtcacagtgggcactgggactgcatgtccccaggggctgcaaactccagagctcaccttcccttgaatacacatccagtatggcccaagcccacgcatactacagggagtccagcctgcctggagtgccccctcactagtatttaggacaccccagggaaggttggcctgtcctctatttccagaggcaggcctttatcctctgtgaccacctcttcacccaagtacccaggggacttcatcaagcacagcacacatcagactgtaaggtttaaccaaaccttatagaggctgtgggaattacaaacaactaaattcagaaaaggcaagcattggccgggcacggtgtctcacgcctgtaatcccagcactttgggaggccaaggtgggtggatcacctgaggtcgggagtttgagaccagcctaaccaacatggagaaaccccgtctctactaaaaatacaaaattagctgggtgtggtggtgtgtgcctgtaatcccagctactcgggaggctgaggcaggagaatcgcttgaacccaggaggcgaaggttgcagtgagccgagatcgctccattgcactccagcctgagcaacaagagcgaaactcagtctcaaaaaaaaaagaaaaaaggcaagcgaagcctcagaagagggtcctcagtgcctacccacttcttagtcccctgctatcttctgccacactatagggacctgcttttctttcacagatttggggtcccctccccctgccctcagccccactcccttggccccagagacagtaggagaccctctgctcccctgagcccgggcctgtctcgcatttcccgtggagatgagcaacaaggggaaacgtgggtcttcttaaagaactttcctttccgccctccaccaccttggcaaggcagccagatgcatctccgaagtccagctcactcaggccagctctcttcacagactgtcttccagcaagaggcaaagcagagatgagacctgcacgtgctctttgtggcagagctggccttatacgcactcctgggtgaataaacagggagacatctcctaagaacaaacgcttctcagaaacagtatagtctaaactcatactgaagggagaataagccagccacgggctggagagacccccgcctacattactaagtaacaggaaaggctaagatttggagccttcctccggttcagatctatcccgggagtaatggaagatgcttgcctgttgacaatttttttttattaaaaatcccacccaggaggtctctcctgataggaggggaccatcctatcctctaaggcaaattccagcttcttccctgaaatgtacatccgctactgagcctcagaatgctatttgttccacctacttccacagttttaaggtcttcagcaacaggagaagacagcaggaaaacttgaagtgcagttggctcccgctgagatgtcactagcagaaaaagggaacacaagcaaaaggcaagattctaaagacagaggtgacaccttctgctccaaacatttggagggtcacctttccagaagtcagactcgaagtcctgaattctggcatgaatgagttctcctacgtgtagggggtggcctggaaagatcttaatttgtaagttgacaggtaaggggccttcagttggagaatcttgtcacctgattctcaaagccaaaaatatcttactgtctgaaacatgaggtcttgagtagttcaacttgacccatgcagacataatttgagagacgccaaggaggattaggaaaaaatgtatctggtcttactcaactctgaacattgcatgagtcaaacgttttcctagctctctgtttgtgtgatgggtccactctgatggattcttggcgatgtatctttcatgaccaaaattcaaaagaggccattcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacgccttcattttctgcctgagtaagtaaatgaccaccttttttttttcttttatgagagtacaatatgagaggaaatctgtgtctcttagaaaaacaaaaaacttccttttacacctacctattggcaaaattttccacttctgtgagggtactttttaaaaataattctaaatcaatttaagagacttttatttcatgcctagtttgggtcttaattgcttttccagaacaggaggaggagggaaaggttttagaactcgtaggaaggttccagtagctccttatatcaaagtcaggtgaaacatgtcagggctgaatgcagccaccagagttcgcatggactgaccagttacagcctgcaaattctgaatcataaaaattaaattagtctctctgggatggcttacaagatttcataagaccaataactggttgggttattcgtggcttgaaagtagcatcttactatgtgaccgtgctgatggtctttaacatctgtggctgaatttccaatgcctttaacatcaccatgctgttgaaattggagttaatttgaagaattaactaatttgttgaagaaagtcacactgtctcatagcctaggttaaaatgtgcagaattcagaaaataccacacaggaattacagaattgccatctcttgtagacttgcccagtgccccttctgagttcttcaaatagggtcacatattactaacaatatccagagatattgtttattgagcacctactatgttccaggcaaatatcagagctaaagctgaaaactggcaaaggaagatttctcctctctagccaactttataaacacagacagcagcaggtgaggacaatccctttaaaaataagccccatgtgagcagacacatgctgtggctgcagtggccccagccacctccccgtcctggggatgggggcggtgtccactgacctaatcaggttcgagctaaagtccctgcgtagctggtcgtctctggcttcctgggcagggtgcagcctcacccccgtgctggtttcctaaggctgctataattaattatcacaaagtgagtggcttaaaacgatgcaagttattatcttacagttctggagatcaggagttcaaactcagtctcgctgagctaaagtcaagatattggcttggctttgttctccatccccatgattcaattatctcccaccaagtccctcacacaacacgagagaattatgggagctacaactcaagatgagatttgggtggggacacagccaaaccatatcagtgctcaacaccctcccatctcttctcaaactctcaatgccccagcccctccaccacaggtcaggacctcgcctcctttctccctgagaaatcccaaccaatcgccggggaattctacagattcccacctgccagcctctgtcaccatagacctcagcttcctggccatcatcagagatagctaggagagggatggtcaggccatgtgtgtgcacactgccggggcaccccaatagtcaaaaattatttcccccaaaaattagtatttacaggtagaaagagagaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatggttatattatattgatggtgttataaagtagttctagataaaaactattttcaaaaaagtctttaaatatatatgcatacacctatgaatattaaagcaaaagaaaacatgtttatgttaatcaactgaacatttaaaaataagataagcaaaataattgttcttgttgtatattcacatgctacagtttcttgtacctgactgataccctgtcactggcatttttcacaagaatgtattttcttcagtggggtcttgttatttttaatttttccatataattgcctgaaatcttttttccacaaattttacaattaacaaatttaaattagtaccttcaattgactcttctcttgaaccataatatattgagaaaatgttccctgtgcaggttctgagtgataagctctcagcaaattctgccaggcagaggctgttctcaagtccaattctttgcatatggaattgcataaatattttagcccagatattttcacaggtgctgtctttgtgccttagtttggaatgtagtggtgcgatcttggctcgccacaacctccgcttcccaggttcaagcaattctcctgcctcagcctcctgtgtagctgggattacaggcgcctgccaccatgcccggctaatttttgtgttttcagtagagacaaagtttcaccatgttggccaggttggtcttgaactcctgacctcatgtgatccacctgcctcagcctcccaaagtgctgggattacaggcatgagccacaccgtgcccagcccacacgtatttttttttaaccagattaaacctttcaaataagttgtacctacttataagttttgaatgttttgtcagattcagatactgcaaaaaaaaaaaaaatcattggctttctcaatttcatctcatttcatacagaacatgaatttatccaattaaaaagattcttcccacaagctgaaatgttccagagctcattttagaatttcaaaattaactcttgtacagcatttgattttgatcattttctgatacattttataatttttctgcataccagctttgttttcaatatttataattcactaaaagctttgaaagttgacgttttgctgctctattcattgaataacttgactaaatatttccaactgatttggaacaaaattcaacgaaaatttatagatctgttttaatacactgtttaataacattttaggatgctgagactcaatgtccactaaaattgattgataatgggaaaataaaagagaaaacacatgtgaaagtccagttttttaaaaaaattcatgaacaactttatcacaagtttgtagttcagtaaatctgtgcatatgttttaacattttgtaaattttgtcacgtacgtctataaatgtcaatttatagaatattgacatttatttatatgcaataacaaattgtgtgtgcaccatgacctgttccaatcacatttctgtttcattagtgtcttaatttagtaggaatattattgttaccatgacgctggactccaccacaatttgtgttttatcctcacaaaaatgcaatgactttatttccaatgtggaaaatttaaacaacttaaatagcattcacaaaaagtcagttgtttcactttgccagaatgaatgtcccaaagccctgcttggcttccatgagctgaatgaaagaatgaattgtgattggaattaacaggtttttctgtctgaagagtccgaggatactggtgttgagctggcaccattttgctttctgtgatgttcttcttatggagccaacacacagtcagccatcacttccactgttgcacgtgcacaagaaaagctggaattaaatgtgagctgagttaacttaaagaacagtcatttgatctaagggaaaagtcatgcctctcagaatgatcttatatcagcatcttttgcagctacatggatgagaaccgtgtcttagggtgcaatttttttttttttttttgagacagagtctcactctgtcacccaggctggagtgtactggtgcgatctcagctcactgcaacctctgcctcctaggttcaagcaattctctgcctcagcctcccaagtagctggaattacaggcacctgccatcacacccagctagtttttgtatttttagtacatacagggtttcaccatcttggccaggctggtcttgaactcctgacctcatgatccacctgcctcggcctcccaaagtgctgggattacaggcttgagccaccacgcccagcctggtgcaatgttcttaaaattactaatttctaaagtagcagctctgtgtcttaggttttcttgcaatcagtgaaattgctacagaccccatagtgatgcaaatgtcaacaaacgttctatgcaagctatctgctcatcaacaacttccttgagcaacagaagtgcagtacttaaatttccattaaatatttgttttttagctcattactccaaaagggtttatttcaaattctttaagtattgccaaatgataaaatacacatagttttggatttatgccctgcaaaaaatgaccaaactattgtaacaagagcctccagcctcctccatattatgctctgggtggggactgctcagcttccatgtgccatggacatttcacaaccaccaaatcataatttcccatgtctcctgttgatctgtcaaccggcagctgtgcaacttctgctcttttatctactctctcccttggtgatttcatccagccttgtggctttaaatgccattcctatagttacaactcccagttaggtctcatcatcccagatcttgtccctgaataccacacttgtctacctaattgcctgctggatgtccccatgtgatgtccaatttatatctcaaccttaacaattccaaagttgaactcctgttcttccccaccccccacaaaaaaaactgcttcatcttcattctgtcaccttcatttcagctgatgacaacttcatacttcccagtgttcagtccaaaaaccttggcattgtccgatttctcctttctcccacccagatccaactgaaaatcacggtgttactacctccaaaacacctctagagtttgatcacttgatcacttctcaccacctgccctgctactctccccagctgtcacccgccagcatgtttatttagtgtgtgtattgtttatcaacttcttcctcctgctaggcttatacgcacactgagagcagggatttttgcctgctgtattcactgctttgtcctaaatacctagaacagtgcctggcacatagtacattctcagtaaatacttgttcagcaaataaataactggaggaaccagtgaattataccccggtgtgaataactccatgtgagtgacatgacagaatgtcagagctagaagggcctcttgaggacatcatgtcttccttagatgaggaaagtcaggctcagagacatgaactgactctcctgaggttacacagccaaatatgctcttccaaggttaattctctgctacacaatagcttttgttggtatctgtgaggctttgcggggttgaaggaatctcaggtgtcacccattaataacaatcatgacagtgacaactaatgtttgccacgtgcttacaataagtcaggaaccctgccaagcaccgggcgtatattaacctatccaagctggggaagaatgtttaggctctgaagattgtctggagccgcataaatcccgcagtgtaggcagctgctcattctgcagatagtattctgtggatccctgagttggctgtggccggttttgccagcaggaggccacgaagccatgagcacaggatgggatctaccccttgtgggatcgcagagggctgggagatgcagtcctccctatggaaagagacagagctttctatccctctcccggtgaaactcagcatgggagcatgggaggcaggtcagctgcgtggctatgaacatgagctatggggtgcatgcagaccaaggttcatagtgtacactgtacccaccagctgtagctcctccagcaagcgtgggaggccagtcagctgcatggctgtgagcacggcctctggggtccatgcagaccaaggttcctggcgtagcactgtaaccaccacctaggtcttctccgacaagctggttaacttctctgagcctggctttgtcattcatcgcgtggggacaggtgcagcagaagagagcagacagaagcacaggatctcaatcaggctcttgaatcagactgcctgggtttgaatccaggccctactgaccagctgtgtgacctcagacaggcgactccgggtctcagcactcaattttctaattggccaactggagatgacaatggcccctaccttgaatggctgccaggaagattaaatgagaaaatacttaaatgtgaaacacttagaatggcgcctggaacacagaccattaataccatctaacagatgttagttgttatccttatttattactcatgctttcctttctcttttttcttttctctctctctctctccttttttttttttttttttttgttgttgttgttgttgttgagacagggtctcagtccgtcggcccagactgaagtgcagtggcacaatcatagctcgctgcagcctcgaccttccaggcttaaacgattctcccacctcagcctctcgagttgctgggaccacaggtatgcaccaccatgcccagctaatttttgtattttttgtaaagacaggatttcaccatgttgcccaggctggtcttgaactcctgggttcatctgatccatctgccttggcctcccaaagtactgagattacaggtgtgaaccaccacacccggccaatactcatgtttttcaagcctgtaagaggaacctcctagcactgtccccaccccggccaccacactggtcccagccccaacaggtcagcttcctttgctgttcccgggcttccctcagctctatctcaagccatgacctctgcctccatgtctgcagccccatgaggctggggctgctctgtcctgcatatctccagtgcctggcaaggggctggcaagaggtagaggctcattaaatgcctgttaaaaccctaatagtaataataataatggtacagttgttactaagactaatcactaccttccaaagtctttcctctatgcaaggcacggagctaagcaccctgtagatcctgacaacagccctcccgtgatcccacaagagagacacgattctctccaatgtttaaaaaggaaagtaaaagtcaatggttctaagtagctcacactgagtgattgtaccgggatttggactcaggcaccatcccttaaaccagaggtcagcaaacttttccccctcaggaacagatggtaaatatcttcagctttgcaagccagacagtctctgttacaagcgctcgactcccccttgtagcatgaacacagctgtagataatacgtccaggaatgggtgtggctctgtgccaataaaactttattgtccaaaaacaggtgacaggttggtttggctcataggctgtagtctgccacttcctgttttattctaccttctgttcatttcaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaagcttggctttcttatcaattctttgtgacataataaatgctattgtgataggctaaatgattactcccgtagattggggggtacctaatccctggacttgatgaatgttaccaaattaagggtcttgagatggggagatgatcctgaattatccaagtgggccctatataatcacaagggtccttataggagggaggcaggaggctcagagtcaggagatgtgactatggaagcagaggccagaggaattcaggacggccactacgagccaaggattgcaggcaccctctagaggctgtaaagggcaaggaaatggcttctcccctggagcctccagaaggaatgggtcctgccaactccctgtcttcagcccagggaaacagatttaggatttctggcctccagaactgttagaggatacatttgtgttttgttttgctttgtttgctttgctttgctttgcttttttgagatggggtctcgctctgtcacccaggctggagtgcactggcacaatcacggctcactgcagcctcaacttcccagactcaagggatcctcccacctcagcctcctgtagctgagactacaggtgtgcaccaccatgcctggctaacttttctattttttgtagagatggtgtcttcctgcattgcctaggctggtctcaaactcaagggctcaagtgatcctccactttggtctcccatagtgctaggattataggcgtggccactgcgcctggccccatttgtattttaagccaccgagtttctggtaatttgtcatagcagcagcaggaaacaaataacaagtatcgggtaatggcctctcttattacacttccatttgtctattcaaagctttctaggctaactgccaggaatacagggatggtatagctagaagttctatattcaaggaacttacatacatctaaatattataatataaaaaatgaaatgagaaattgcatgaacacaccacggatccagcatcttgcgccttcagcgagaaaggggatgggttccctctcaggttagcagagaagacgctgtgaagggagtcagccgtgagcctggtttccacaaagggtgcaatctggatacgtggagacagggaggaagggctggcagaggcgggaaagggtgagctgctcacaaaagaatgcttgtgcatgctcttattgaacgtgtaatgcattggtgcgggtcttgctatgagagacccaacggtgagcctaacggtgtctctaccctccaggggctcacagcaaccaggacaataattaagggattgtcatagagcaggatgcccgccaccatcagggtgaggggtgccgtgagaaccagagcagggctccagtctgggtggctgggagggatggttagagaggggttcctggaggaagagacacataaactgaatcccaaaaaatgagaagctggccaagcaaaatgggggaaaggagtgttccagacagaaggaacaaagtaggcccagaggcaggtggggttacaggttaggagggagaggttgaaggatggcagaggaggaggcgggtcatggagagaattggggctggaggagaatggacaggctgggtccaccatggtcagctggcaaagacagttcacccaggaaggatggtgggctccaggcagctttgagggccccattgaagctggaaagcgtggctgtgttgtgtgaatttactctgataatgctcgacagacccaggaaaggattgctctggagtagggtttagccagatagacggccatacgtcatgggagttggggatcctggtcagactcgggggaatgatggagagggaagaaacgagcacagggagagaaggaagtgaagtgagatcagtgtgttaaaggatggatatagtgagagaacctgggtgacagcaagaaacagaagaagagccaggcgtgatcttctgtacactgtgaagggaatcagccgtgagcctggtttccacaaagggtgcaatctgtaatcccagcactttgggaggctgagacaggtggatggcttgagcccgggagtttgagaccagcctgggcaacatagcaagaccccgtctctacaaaaaatacaaaaattatccaggcgtggtagtgcgcacctgtagtcccagctacttgggaggctgaggcaagaggatcatctgagcccaggaggtcagggctacaagcagtgagccaagattgtgccactgcattccagcctggctgacagagtgagaccctgtctcattaaaagagagagaggaaggcatagccacagagcaggaatgtttgagtagaacattccagaggcagagccatctcaggagatgacaaggaccaagtgtatccctggcaccaggtggctgaagtagagggaagaagaaggaggttggagacaacatagagaatggagaggtcaggtggtgggtgggccctacctgggccctcacaggcaggcgggacattgtcaggccctggggaggagagagtccgtgggccaggaggccattccaaggtcagtttccatggagtgggggagagggtgtagtgactggactccaagacacttgggggaatggggagaatggcagtccccacagctgcacgggaagggctggtcctcacagaatagcagcaaagactcattcattccaggaatggaaagaatgccatgttcttggagcctggagacagggtttgagaggctggcagcggctgggccaccaggacctcatcagtgataaccctgtgatcagtgttccagcccctgcaggtttcctggagagcagagtgtcgtcagaaggcctggagctgagccaacaggcaagatccagcctgcacatgtgtttaatttgaaccacatggtattttttaaaactccaagcccccaggctcttgagttggttaccagtactgaaactccccattgggagccagctttccagtttcttttgaaagtttggaacatccagcaacactgattcaatttcattcattcagcagatatttattaagcatctactttgtcagacactgttttgggcactgaaaatatggcagtgaacaaaagagaggaacatccctgggcccttggagttgaccttccagggtccccccggggctccaattctttggtgctgtgtagcagaggccccgtgaacagggcgccctcccatcaggttcacacgcatggaagctatgggaggttaagtttgcaacccctcatccagaccatcccttcacatacagtctaggaaacagagagcagtaagacctgcccaagcacacccagtgcgactcagcagccacacacaggagtaggctcagtcatctcatttaatcgcctgactcccttgtgaggtctgtttcaggatgtccactttctaggtgaggaagaggaggctaaggaaggcagtgcctgctcagactgcagaggctggattcacccaactcatctgactccaacaccaatgtgatttccaagcccccaggcaggaattcattgggcaaaggctctgtggcaaagtggcaaaagtaggcaggaacaggcaggaatagagagtgggaaagggaaaataatacctgattcctcttctattccgagtgagctgacccacatatgccctcctttcttctttttcagccggccttaagcaggtggcttatcaaaatcctttcgaggtcttgcaaaaaccaatcccacactcgagaagaacgtgctggccggtgaaatcggacaacattgctcacgggatgtaattcaatggtagactgcagccacagcctgagaactcagacacctgatttatgagacgcacataagtaacgtttaccgaagcccagcaaatggccccacagtgggagagaaactggcaaacccgtacagtagaattctgttgcccttctgtggggaaggccagttattcatttacagagggagaaatttctgccttgactaaaaggatcgatgctgtgggaaaaggtaatatatctgagttcccatggatctggttgataggttcacctggcgtgttccatatggggccaggcccaggccacacctgtggtgctaacacctggggtggagggaggaattagcaaatagtcttccagcatccccagctccagcacccatgtgggcttccactctctccctgagaagggccaagtagaaagagagaacaaggtttcactccaatccgttcccagctctgggtctgtcctgggctccagaaccgcgtgatcaggggccatatgtggccttcactgctctctgcagtgggaaggtaagaaaactgcccccaccctgccccatcatcaccccaatccatcatggggagtgggtggcactaaggccctccaaatcccagcctcggggaaactccctgatgttgcaatggccacaggcaggctcttgctctccggagatgagtcacaaatttgatgaggagcaggtcggaagcagccctggaaagtgttcctccccacccctgctcccaccacagctccgaggagcctgggcatccaaccagggctgatccaagccttggctccggctgagctccgctctggcctctgtgcaccttcagctccttcctgcccttctctttccctgtgcccagcccctttctccagacccccttgattccttctcagcatcctcttgcctccccggaccacccccagctcaggcccctgcccaagaagggcctcaccgcggggctgcagagtgcacagtgcagccggtcagaggtccaggtctctgagtcacacatgccactgttccagtcctcactccaccaccgcatgggcctggccgaccaccgaaactcggcatcccatctgtaaaatgggaatgaggagagcagtgcctcactgtgtcgttgtgaaaattaagtgacccaaaaggacggccttattccctttttggaaagaggtaatgggcaaagaaagggaaggaaaggcgagaaaggacaagaggaaggtcagagatgtatgtgagacaccaggacagcgccaccccagcaagcaccaacaaccattttctcctatgagcagaagaggctttaactatgactgaaatgaatgcatgtcaaagcacagtctgaataaaatcccaaaaatggtgtccgtgtcactctcctggttgtgatatggcacgatccttgtgtaagatgttactattgggggaaactgagtaaagaataatggggccgggcacagtgctcatgcctataatcccagcactttgggaggccgagacaggcagatcacatgagcccaggagttcaaagaccagcccaggcaacatggtgaaaccctgtctctagtaaaaatacaaaaattagccaggcatgggggtgcacacctgtagtatcaggtacttgggagaatgtggtgggaaaatcagtagagcccagggttcaaggctgcagtgagccatgattgtgccattgcactccagcctgggcaataaagtgagaccctgtctcagaaaaaaaaaaaaaaaaagaatgagtacaaggcatctttcttatcactgtatgcaaatctactaaaaaccttaaaaagaatgcatcattaagttcaaccactctgccttacagatgaagaaaccaaggtccagagacaagcagacttgtccaaggtcaccgagtaagcagggctcctgctgaagggctctgttcagacccaagatgcccgctgggccctggtgacaggtctcagtctcaggctgaggtcagagaagaggcctgagtgccagggttctcatttgagtggccatgatgattgcagagactccctatggccaggattgtgtttaaggcagtaaacaggaagccaagcctacttttcaggagcttcaggggacagaaaactatcaggaaggattggttgggacccagcaagtacgagaggaagacatttcagggcttcagtcaacaaggggctcagtgtactgtagctgccaaaatagctgccagctctcagctgcattcaaaggagtatagcctctaaaatgaggaaggtcatattcccttaatttagcactggacagggtccattaggagtattgtgtccagctcttggctgattccaaagacagggatcagactggtgagaggatgcaacagcacaccctccagacacatggcggcagagggcttaccacagaagataagacttatgtggagagaggaacaaatgcacttagtgttaccccaaagggaccaaagagaaaaaaatcctgagaaacactttctgtcttaatttaaggatgggctctttgacaggcagagctgtcccatgatagaactgatggccctcaatgacgtgggttcctggtctctggaggagcccagcgaagctgcaggatctcttggcaggaggctgcaacaagaatccaggaagcatctactgcacactcacccttgaggagctcactgcatgtaagggaggcagaaaagaaaagagatcattcctcagtgtgagatgtctcgtcatggggtgacgaagtctgctgcaaggagttccagaaggaaagggggttccttgagctggatcttaaagttaagtaggacaatgagagtgttggccacctgcaacttttccctcacgcgagttctcagccaacaaaatcaagggctggaagatgtatgccaatcccaaggagtgactgttgtcctctgggccatgtgagtcagtgaagactgaacaaggaagtggcatgtttggaactgcatttcagagagatcactttcactagaatatggatgatggcttgcacagtgtatcagttatctatgttgcataaaaaaccactcccacacttagtggtttaaaacaaccacctcaactcataattctgtaattggccatttgggctgggtttagccgggtggttcttctactggtcttggctgggcttactcatgaatctgtgatcaacagccaggcagctatcactctgcttctggagaatgggcaggaggctgcagcaagcacaaggccaacatcagatggaattaaaacccactgatggggccgagagtggtggctcacacctgtaatcccagcactttgggaggccaaggacgtcaggagttcaaaaccagcctggtcaacatggtaaaaccccatctctactaaaaatacaaaaattagctggtcatggtggtgcatgcctgtagtcccagctactcgggaggctgaggcaggagaatggcttgaacctgggagatggaggttgcagtgagccgagattgcaccactgccctccagcctgggtgacagaatgagactccatcttaaaaaaaaaaaccaaaaaaaaaaccccactgatgggttaggtgaaattatggcagactagggagtactccagtcctgacctccacaatctaagacagaatcagagcagcttcttcattcatggctttgtgtgtccaacacttactgagtgaccaatacatggcatgtaaaagtaaaattgtaaaagtaaaatataaaatcccaccttcagtgagttcacaggatgtgaaaaagctcatcatgcccattttatagatggaaaaactgaggcccagaatgctttgccccaagacagagcaacttcgtcagtgtgaggtctgggatcaagtgccagctcttctactctgagtactgtagcccaacacagtgctccctagaaaatggttcctgagcagcttgtcttttgaatagaagtgccatttggtcaatgttgatttggggttgggagctggtgaagggcagaaaattcttcttcctcattcttctgtgggagacattactactgctcactgagaattccagttctcctcttctgaaaaatgggaggttgaaggtgctaaacttcctcaccctatagagactaagaatggcttcttgcttgctttggccaatgtaagcaaaattgtgtgtcacttctaggcagaagaaaattcaagatcatagtcctccattctttctctgctgtagaaaaacctgaaaagctatgttaatatagtgatatcattaagatctggggactttatcagcctgaacctctgagtgactaggaaaagcaaagtttcctaccaacctacatcaaacatgtaggtgaggagaaaataaacatttgttgttttaaaccacaaagagtcaagggttttgttactgcagcagaactcagctcatcctgactaactcatcaggttttgatgaagagggattgctccctaaacccttggcttcttccccacccctgactcctctccctggaagaggagtgacttctctgattatccggtttcaaaaaaaaaaaaaaaaaaaaaaaggaattgggcctggcctgtagagcccagttccttactccattctcactctttgggaagtacctgactgcagattggtcttctcttgcccataaggtaagcatagagttaaaggctctgccctagtgggggaagtcatcagcattgcctgggcctgcatgagtcagcctgattctgggattcagtatcaaaaagtctattttctggccgtgtgcctgagtgataccttccaacctagcccttatcagtaataaagaggagagtgcaggccctgtgcactgactccaccgtctgcctctttagtgcagaactcatgagggaaaacaggagtgtcttcacaccccagctcctatgatcctgtccatctcttactatagaggatgcaaatttcaaatatctgttatcccttggagaaagcttgttggtgaactacacatctgattcatgggagatttttcacaaaatccttactaatatcttggtgagttctgatgtaaggtgtattagccttatagatattttggactcgatagttctttgtcatggatgtctgtcctgtgcattataggatgtttaccagcatcccaggcctctatgtgttagacgcccagagcagcctccctctcctggtagtggcaaccagcatgtctcaagatatcacagatgtcccctacggggcaaaatcacccccttccccagctgagaaacacattttagctgatctgatcaagttattcaacaatagcctcaaggaaagcctggttgtctggagagacttcttggaggtggtaggactgaaactgaatcacaggttcaatcactcgccgctggcagagtccaattaacaagagcagggcctggtataaagaaagtgatttatttccaaagcttcacttaggggaagaagtacaagctcctgccttaagggtactgctttgcttccggggcagaaagcaggggctgttaaagtgggacttggcatgaatggcacgcaggggagggagcgggcaggtgggggtctacatgattcttcctagttctgcctgcagtggtgccagctcaaccatctggcagagcagaactaggttgtaacgtggcccgttgtctcgagatactgtccaggtgggagagagttttctagcgggcatacttgaggttgtaaattgactaatgtctctcgaggcagtctcctggtgggagaggggctgggctctggagcttctaagcaagtacatggttagataagcttgccctgtaatgagtgtctggtgaagggaaggttataaattgcatttctaaagagctaagtaggaagtggggaacaggggggaagggggaaaaagaagaaaataataatttaaaaaatccagctcactctctttctcttagaaaaataggtcttcagcccttgaagaattggactttatgaaatgaaggagggaggccatggtgctgggaaggaaagagtgagcaaagggaggcttggaggcaggcgctgatgggatggcagggtagcaggaggatcacacaaactgcagctggaatgatgacatagccaaccatgcacaatcagtcctaaccatctctggcatgcattgcacgtacaagtatttgctaacatcattagagcagaatctctctgtaagtgcaatacgtggcgtcagctcctaacaagtcgctattattgattttggggtctttccctggtgtttcacaacacccccagccaatgccttgtggcttcttccagtgtgattttcccttcactgtcctacagccaaccttgtggcagggaaaatgtaagcctggggagcggtgagaaaggaagaatgggattcatccatcatgaacaaaatgccaacgttcttagaacgatcaggatccagtgggaccagggtgaccttgagggaagtaaatcaagcatggagatgccatgtcaaatcatgtctttatttaaaattttgaggtttcgttcatcatggatgtttttgcattactttttattttttaaaactttgcattattgtttgatgacagatgtgctcccaccttagactttgcgcccagctgagagcctcacttgcctcaccctaatcccaccctgagtgggagggtgggggctgcatttccagcagagggatctggcagagaagcttctgcaggcttctatttcacactcatctgtagacaatcctcagagaaggccacagaagctctttatctgtatacaaagcacatttctattctctcatgccccaaacatgggctttatcagtctgccgtgaaagtgccaccaggggcaattttcatgttgagagagggcctggtgtgctggcccccagccccatgtttacagcgagaaattaaccatggaataaaatgatgtttttctttttaatccacgcagtgtccttgactaagaggaagctgtcaccgacaagcctcgtgagagagttaggatagttaggatgtttccaagtccttcccaccgcgcgtggggtcggaatttgcacgggctcgggtgccatgcttggtagggggtgatttccaaaccaaagttccactgagaagagggcgggcgccccctgctggcatcaggggcagactgctctttccccagacatgattctgcacccactttctctcaaagcaaacccttacatgggattcactacagatccgttccaaagcgaaacagaacacagaaacaggacaaggcctcttgaaaggggttgtttaaagatctcttcaaaaaaatttaaaaataaacctgttttgtgggcatgtcaatagatacaacttccatgggaaggcagttgacaatagctacccaaatttcaaatggtgtcccatattgacacagtgttaccccttatggtgatttatccatcagatatacttatcagaaatggagaagcagcaaagttaagtggctcaaagtgaacctttagggcggagatttggctgaaattccagttcattggcaccaaagcaaatggaaataaaggctgggccacgttaagattgctttccaaatagaacgcggtatggacaattaagaagaaattaaaacggaatctggtgtcaagaaaatagttatgtcctgaaagagtgggagttgagggggagtaaaactttaagctgaaatggaggcgtgagggaaactgtatttggcctttgaagtgtttattattaatggaaggaggatttctgtctacagcattagaacattgatactgtattgaaaatagcatagatgttggcatttttttcacttgtcttttactaaatgctaaacagtttatggagggattgccttgaagtctccatcactgaaaataactgggccacatctgggctgacaaaatgttcacgttaagagttctggaagtcaagtgagtactttgcactgagcagttgtgttttcccctatacttcagtggaatccaaatttgaaagaatggttcgtcctcttctggtagccttagaaattcttacagtaaggatgcactagtgttcatttttctcagttattccaaatctcaaaaaacttggcctccaacaccctttttgaaactgatttttaaatacgacccttgttgtatctctaagattaaatttccttgtaagtaggcaatcctaaatatcaggctaaaaaggagctggctcccccacctaccccgaggccaccccggatctgcgtttaatgccagggaagcagaagtccagacacccagaaacaagacaagaccaggtggtgtcttcaaaaccaggaattccaactctaacagtgctctcagtggtatatgttcctttcctcagcattgtgaactgacactcaaatctctcggggagcaaagcaaattgatttacatttgtaaggaacaaatggctgggatgattaactgtttggtctcttgcatattagaatttgccatcttttttttttcttttatcttttctatggtgtggagagtttgatgtcttctcactggattctgagctccctgggagcaaggaccatatccttcctctccagcgcaggcatttgcacacagtaggcattcaagaaatggtaacaatatctaagtcttatacttaccgtgtgccacagagacactgttcaaagcacttgaatcctcctaccaattgtattattattttatacagaaggaaactgaagcacagagaggttaagtaacttccccaaagccacacagatcagaagtagtggagcttgagttcgaccccaagtagcctaactctaacgtctacactcttagccactgtgtcatggttcccaatcttgtctacacattagtcccctggggagctttaaaaatacaccccagggattgggatttagctggtcttgggcatggcctgtgctttggcatttttgagagatcccctggttctcatgtgcagacaagttctgagacccagtgcattacactgccctgccccattcaccagcagatgtttgctgaatgggatttgctctgtgtggaactgctttcagggatataaacaaacaagcccaggggaaaatactcctaactctggcaacagcatattatcttcaagtgcagcagaatgtaattccaatagagcatgtaagcacatgggtctgcagtcagatattcctgcattcagagtctaaatgggctggttatgatctgcaggtaccagtcaggccaggtgctcaccaacctcactttccttccttcctgggtacacaggtagactccattacccatgtttcctgttggctgtgaccatgtgacagaattctgaccaatgtgggcataagtgatgtttgctcctgtctccctggctatgtatgtcctggccacaaaagtggtcctcctgtctctcctgtgcagagatcccagctggggattctgaggttccaggggatgcagagccacaagatggaaggagcctgggctcctccatcactgcttgaaggagagctgtcagatattccagactgccaaccagactttctgtaaatgagaaataaacctctctttttgttaagctgccgaggtttggggatctagctgtcactagtgactcatgtcccttaacaagtacatggtgtggcttgggataggttacttaacctaagccttagttttgtcatctgcaaaatacaaataatggtacaaatatgaacaagacaaaatagatacactctcctctcttctgcccctctccaccttgccctctgcccagaaccctgtgccttatggactgggcatgagccacattctacccatgggaggttccagcaggagatgggagggcaggagagtgggggtgggggtctatccctctggctgcttccctccacctagggtcatagctccggtcaggcagccctctttcagctattaagttttgggaatcgctcccttcgtcttttcaggactgtggctgtgcctggtgttcagtctcttgagagatggatgaagaaggaggggcatcctaatcccattcccacaaggagagccacaaaaggtgaggaatggccattggctcacatgactttgaggccagggcaggcccagagctgagaggggattagagaagagctaccaagtcttcacttggctcagagacagccacgaggtgcctgtgggcttcccttaccctgtgctgcccaccatgtgctgagtatttccttcctagcacctgtctgtcacatggagtggtcacatctcttgctgggaccctggctgatactgaatgtgaatgttacattgtcaatactgatactgaatgtgaatgttacataccctggctgatactgaatgtgaatgtccccctgccctggtgaatgaggcagggcagtgtaatacactgggtctcagaacttgtctgcacatgagaaccaggggatctctcaaaaatgccaaagcgcagcccacaccaaagaccagctaaatcccaatccctggggtgtatttttaaagctccccaggggactaatgtgcagacaagtttgggaaccatgacacagtggccaagagtgttgtcgagtgccaagcagaggagtcgccacataggaaatagtcaatcaatgatgaacttttatttcatatatatttatattttaaaaattattacaagtattgctaaaatcaagaaaacgtgagcttacattgaataaaggacatctgtaagtagtaatcatgtgatcttgggcaaagaatttcccctctccgggcttcgatttcctcacctgcagacaggactagatgaccactcgggttcactcactcattcattcattcattcactcattcaccatttgctgatccctgactctgggcaaggcactgtgctaggcaccgggtccctaagtcccttgccctcctgaaggaagtcaaacagggaaacagacgtggatctacagtatgcggggagtgccgcaaagtttaacaaacaaaaaaaaggaaagcatgctatagtgggaaacagagaggaagggagggtggccaggctgcctgaagtggagcctccgggctgagacagcaggagcagccagagatcccgacagagcatccgagttggggcggccatagcgcgttcttgccccaggctgtgcatgattttccccaggagagctcttagcccagtgatttttaacaggggatttttgtcatatttggcatatttggccatgtctggagacgtctttggctgtcacaactgggggaggggagtttgttactggcatccagtggccagaggccagcggggggtgggagggtggcaacatcccctgcatcctacaatgcacaggctggtcccaaatgtcaactgctgaggtggagaaacccgactttagccccattctgagattttgctttaatcagtgttgactgtggcctgtggtgcagcatttatagaaagaaatcttccaggtggtgctaacccctactcacgggcatgcagaactgaaccgctggggtggctaagcacagccagaagaggggagaggggctggagacgccaggaagagatcaagcacattttcttgctcaaatattctaagagcctttaatctcaatcttctagcaaaattctgtggtttcccaattagtgaagactttttgctaagttaggtaactgctccaagcttttcttaaatgaagtcctgggaagagcatgaggtctggaagtcaaaccatgtgacggtgagcaagtttcttgacctctctgaacctgtctcctcatctggaaaacagggactctagtaactgcctctgagtgggggctgtgaaattataaaaagacagtaggatacttggcacacagtaagcatctcacaattgtccccatcccttttttcaacaagagccatgggtgaagtgtgacttgtcattttttccctaattgttcaaagtggatgttatatagtcacatctgtcacaacaaaatcttttaaagtaaattgcccttaaaaataagtatgtctggccaggcacggtggctcatgcctgtaatcccagcatttttggaggctgaggtcaagagttcgagaccaggctgaggttaacctggccaacacggtgaaacctcgtctctactaaaaaaacaaaaaatttgtggggcgtggtggcaggtgcctgtaatcccaactactcaggaggctgaggcaagagaatcgcttgaacccaggaggtggaggctgcagtgagctaagattgctccattgtactccagcctgggcaacaagagcaaagctccgtctgaaaaaataaataaataaaataaaaataagtatgtcttttaaatattcccttcataagtaaaaatactcctccaaatagttatcagtttcgtgatatcaaactaggaggtgtgtttgctgcaagtccttattgcagggataggataactaatagagggactaaaatccaaagcagggagggaagaactgttaaaactccatacagctcagcaatcagtagcagacagacccaagatctgctatcagaagcatcaggggcactggaacatcatttcccaataacaaggtctgaggcagatgtacaccccaccccaataagtattttacacaagttttgggaacacttcttggtgaaagacaagtgtttaaagcaaaatccaaagagtaaatattttaattttttcttcaagagtattcttattttcatattatttaaatagtcacattaacaaggtacatttccacaaaaatatttgtacagcatcagtattcttattcacatccataattgccataattaggaaaaattaggaaacttagcaaagacagtcaatacacatgttcttttacttgtggtgagataaattcaatgtctaaaataagtcaggatggatcaacataaaagctgaactagacacccctaccaaatttctcaatgaaaaagcaaatagccctgggtgaccagcaagttatacaaacaatgcaagacaaatccaactagaaatcggaagctgccatttcgtatacacaaaatacaagtgaaacagtgaagtaaacatatttttagagggaggtgctgctacccgggacattagagatataactgagccagctgagatgacatttacaatctcttgaaatgcagcagatggcactctggtgcttcctatgaagcaacatgcttgaaatcaagggccaacaattgttgtaggaaagcaaaatatacctctaacacctacgtttaccaaaaaagctgacatctcaaactctgagttgttgagactcaaatttctcatccccaaagaagcctattacggtagtgtgttggatgctttttgtatctctgatatgcaggcactataatggggggaaatacttctgaataaaaacattggctgacttgcaactgtgcatataatgtctattcaagggggcagtgtgcctagcatgatcctgaaatgttgagataaaaagaagttggcattaaagcactatttgtcttatatgaaaagagtgactctatcttccagtaaacaagatttcctgcaatgaaaaagaaatttttccttcattatctataaactatacaaataaccttcctttttaacctaagactcaaacatttatatttgattttattctatttgataccaattggtatgtccagctgatgcatttgcagatacaaaagaatattgctttgtgtttgcacagtcccttcctttcaaggaacttaaagaacttgatggagaaaagaacttgacggacattctctctgaagtcttaaggaggtcaaaagtaatgaaggaaaacagaaggggagtgctcgttagagcccaccatgccccacagttctgaggatgcgggtgcgaggactctgaagcaaagcaaagcagagggatctctcagacgccaagtcacacagctctttacacattgaaaatctgagttaatgttaagacaatgattagtcaatcctgaaaccatttagtgcaattggggattcctcattttaagtcgctgctttagaattccgctcccctgctgtctgcattccggtggaagcggcatgctgcctttggacaaacagcctctgcaggggcagacacagttgtctggactcttttggaaatgaacaaagacactaaacctacagaacatcgtttttaaaggagatagttaaaaagtaatgccctaaaagccagaaatatttcaatcggcttgaaaagtgacacacaacaggagcaggaaacaccagtttttagtattttgccatcttaggcacactgctacttggaaagattttttaagtgaactttgccttataaaaatattgataaatatatgtacttaagcgagaatccaaatcgtacccaaacttcatgaaagtgaaagtctattgctatgacatctagaagaaacactgagttatctaaaaggcaatgttcagtggtgggcagaaaggaagagaaaacggggggttccgagttagctccattcaagaggaagacacggttgtggcctcagctgcctctctactcgtcatgtaagggggtcttaacatgtcagaacattgtggggtcctgcaacttgctgacagatctcgatggagctgcttatgggactccatggggggaactgtaaggactcaacgtatcactggtggacatgcgcgatctactctagtcagaagcatgacaccaacccaaccacccaggcacagtggcagttcagaaaagtattgctctgagagatctgagatctaaggtggcccctggctgctccgcgtgtgatgtcgccagagaggactctcactggacgaggcccagtggtctgaggctctgtacaaagcatgacgccacatgtgatcattctcacacgcacacacagcctaatcatccaaaacctccctttgggctttgtcgtaaaaaaccctccatttaccaggagggatgctgaggcttacagggatcagatgtcctggacaagtcatccgtttggtaagctgcagatgtggcaaaccacggattctagccacgctctttctactgtgtcatcacaacaccaaagtctgaaaagacacttgtaaaaaagaaaaagcttaaggacatttaataatgtagaagtgttccgatatagataaacatctttccagaatctcaggtaaagaacatcttggctgaactgacaacgaatctttttgagacacaacgtttctgttcccaaaatgattacatcgacaacaggtgcaggagggtagaacaaagaaagaaccgcggagattacattacaaagatatatgtttaaatgagatttgtaaacttaatttgtttgcaactccgggtgcaaagaagagaataattatttttctctatactgtagttaattgaacttaagtacaactgtggaaagtatatttaaaagttagacagattttacaattttaagtttgatcaagtgttttccagtttgactaatcataactgggttaacacacatagcaagtttccttaagggcaaatggaaaatgctggcatctgagcggggtggtcagaacgcaccccacagccagaggcgccttcccggtaacacagcacgccttcctgttagtgtgtcgccaggaccaggctctacccgaataagagatggtcccacggtgcttaaacaggtggttacgctgttgtctttttaagttttttggcagtaaaaaggaaactaaaattaaaagctatataaccccatttttataaattctaaacattttgatttttggtttacattgctttcctgcttagaaaatttagagaacgaaattgatttaactacattttccaagccccaaattgaaatgcagttctgaaattgaagttcaataatattcccccaactttagaaaacaggaagtcaggtcatgcaactttcaacagtggatatatacaaagttccaccttttctttctgctggatcaatctaaagtcaggaattgacaacaatttccctcttactcctaggtaatgatttacctgatattaaccaaaatcgattttgagaaagtgttcccaattatcttgtggtaaatcacagtactgcatctatgaatatgctctaagaaaagcaaaatattcatggaagcataaaacaatatcacctttaaataaaaatactttattcattcctgataggttatcaaaatgtacactgttaaccaagtaaaaatggtatgctgaaatagttaactagggcatatttgaagaattttgtttacttttaaaagaggaaaaatcacttccaatcttcccttccacacattcctaacaagcctgcactatacctgcttaaaactgaaaatataaacaattacatgggccccacttcattacagaatgcattttcctgtactcttaaaggaagctattacattgaagttaccttcctttgccaaaaactttcagacaagtttactgctctttatattttgtgtaactttgtaaattatacaagaaatatagcacacaacttgaattaatctaaaaacacatacacataaacacaggataaagtgcaacacaacagaacatgtctgcaacattcactttctcaaacccccacagaaggattttcggagtaaatggaaataatgttgttctcaagtgcatgaacactaaattcaacagaataggttatttttccacactgatatttatattgaaaatcctatttgctttgcttcccctgtggcttctgtctctcattttcagttaaaagttccgaagctgtgattctttttaaaccttaagaaaatccaactccacagagctacacaaagtgttagaaggcagcttccaatgatctctcgtcggtaacaaggagaattacagtcatcttaacaaaagtgagccttccactaacttggcagcaaatgctttaaggacctttgacaccagccaccaaacatttctataggcaagtatcaactataaatgtcagaagtttttggttgcatgttgttttgatgttaaattatttaactaaaaaatgcttttgttcctgagatgagcacaataaaattaaacgagcttcctctgaagctgctgtcaggactctgagctcctggttccactctccttatcttcacactgtcagttccaagccatcagtcatccccgtggcgccatttctgtgactcgtcttgccggacatctggcctaatttggtttctcatgccacccagcacgtttgacgttgcttctgtggcaacaatcagaggtttcaccactgccggaggaatctggcgcagaacctcgcccacggcaccagtcacccctctgctctcgtgttctcgagccgcagtttcataaatggtctgagccgtgtctgtgattccctgcgtagaggagggaggtaggagagaggagggcagtgaacaaactctggtcggaaaactctctaagctatcctgcagtacacacttttaaagcaggtaacattatgtttgtaaccagacaaaaaaaaatgccatgcttttagataaaccaggattattatttttaatgacagaattctaactataagggaaagaggcaattatgacttagtattttgttgtgacactagtgcgtggaaaatgtaggtaaactaaaatttcgcattgggaagacagaaatacgggctttgctggtactattaatcactccagttaaatcaaacttggcaaacaaagcttcttgaatatattcactaaagaaatatggtgatagttccctttgattcaacctaattctactaagctctgggaaattacttaatttgttttaaattactggctatgtattaggaaaaaaatggaaaattcaattaagataaaaagctcaatagaacattttattggattagagaattctgagaacaaaaagcaggaacatgtttaataattctcaacaaaactttagtagcattttccatctttctcacaacataataaaataatgatgattgctaagctttctttttcatttattcagtctctatgctagtaatgacttctgagctttgaagctgaatatacaaacatgtaggtcaaaccaatgtggtaaaacttcacatgacttctgaatctttaccatttatctaactcagaaatccctagggaactcaaagcaacattccattattattattatattattatattattgtgacagcttcagtgatggggacagcataaaggaactttgagttctccagggaaatcaaggaccttgaactaacccagaatctagccatcattttggcaagttaacaagagcgtcctatctacccagtatatctggcaaaaacgtaataccacagagcaataaaaaagatgtccagaaggccgggcgcggtggctcacacctgtaatctcagcactttaggaggccgaggcaggcggatcacgaggtcaggagatcaagaccatcctggctaacacagtgaaaccccgtctctactaaaaatacacaaaactagccgggcgtggtggcaggcgcctgtagtcccagctacttgggaggctgaggcaggagaatggcgtgaaccaggaggcagagcttgcagagagccgagatcatgccactgcactccagcctgggcaacagagcgagactccgtctcaaaaaaaaaaaaaaaaaaaacgtgtccagaaaaactcaaagaaataataagtactactttaaaaactatctagaggataacagccaataagagaaaccatgagcacaacaatgtttacaacttgtacatttccctgcaccatctccctcccctctccaccagctctcctccctatcccacctgcgataaacaggagtagatgagtagagtacgaggccgaccaccactacgtttgcggacaacagaagtaaattccagtctcagccctattatttagctgtgtgaccttagataagtcatttaaagagggaactaaaatgctgccttcctcctacggtgattgttagaattaaataattcatctcaagagcttgacagagtttggaagacagtaagtgttcaataaataattcctactaccaccctcgtaagtgcctgactaccaccaaatagaactatgtaagtaggggttgacatactttttatgtaagggccacacagaaggtatttgtgggccatggtctctgttatttattttttgttttgttttgttttacaatcctttaaaattgtaaataccattattaatagctcaaaggcccatacaaaagaggcatggctagtctaccctgcagcctagtctgccaacttctgatctaaaagatgagcctatctatgacacacacaaggcattttctcttcatctttgacttactgacatctaaaatggaaaagaaataccaagcaccacttaggaacttttttttttttaactttaatagagaatccagagcaagtccaaacaagcacatcctaccatctcaatccacacttactaatctcaccctcccttccctcattcttcctagtgacagcttagagaaagagaactaaactttaaacccaaatacccagttccaatcctggctccactcccttttctctgtggtacttggggaaggccactgtctggcagaacccgtttcctcatctgtaaattagaaatatcgcctatctctaatggtgattaccatatatttggcacaaagtaagcacacatttattttaaaattaatatagattaaattaggcaaccacttcacaagttgttaaatcaaactgctattacatcttactgcccactgcccttactaaccccagtgtctgtttcacagatctaattttagcctattgatagctggctcaatcctgacatctgtaggagcaaatctgactggtaattatctctttattctccccagtaaatctttttttcaaagctgaccattggtcttacctttatttatccactaatacatttcttggggccctaccttcgtggacttcctgccgtttgggaccacagaggctacttttctcaagtaaaagaccatcctaggcacgtctgactgttgttagaatatgactgagaaaaatatctttcatgaaatcctaaaacacaaatcataagtcaaatgacctcaaactcccttatgtcatattaaaaagaatgtcaaaaagagtatgccagggaatgacgctgacaacacccagaaaaaaaaaaaaaaacagggttcactggcacaaccgtgtcagagagcaattcagcaatgcttaatacatgtcgagattccaacggttactccccagttgaccctaaagaatttcttgtacatatgaacaaaaagagagttaaatgagcactccccatagtggtgtttcaggggaaaaatggaaactgaatgtccaccaacaggaaaataaataaattatgatatattcatacagtgaaataccataaaactgtggaaattagacctacatggattaagattaacatggatctatcttgaaataagttgcagaatgagacacataacaccatttacggaaacttttaaaacattaacactagtatgttttgcttataaatacatactaaataaaaatacatacataataaaactatataaaaacatgtacaaaaaaatatgttccacgttcagcatagtgaaggcatgggaataggatcagggtgggagattcatctgaaaagttctagttcttaagcaaatctgaggtaagcagggcagagtataaatgtgttaaacctagacagcgatcacacggcatttgtttctatcactccctgagtgcttctgcaggtgaagagagagaatccatccacccacgcaatcactagtattcctgtcagcctattggtcccagactggcccttttccatcacctcacacagatatgggcacatgttattagtggcagttgccattctgctcccagggatttctacagaatacatttaagccattaaatgctctttaggtgaaagttgggaaagcgcacagaagggttctgatgtgtccacccaagtattcagttacctctttcacaacactgtaggccttggccacaccttccctcaggtctactggctggtgggctaaccggtgatgaggaaaccttttggtcttcttgggctcgatagaaagggtaccaggagacaccatatcataagcagtctctgcagctgcctggatcattttgtcaaaaggaagaaatgaattagaagaaagtctgaagagttacggaccagcagagcacttcctacagggagtgaggaagagcagaggaactcacaaaccctaatgaagacacttctgcgtatctgaattctttaccacaagaattgatgacttttataacgagaacataaaagtataaattaataactaacacctggattgagctaaatttttagcccctcctctgttcactgagaacactcaacatttccacatcagtctatggagcttaatacttactagaatgatctttaatacttctgtttaatctacaacgccttcttcaaatttagctacgatcctttcatacaaatatggtgaaatcaatcctctgctaacttaatgtttacaatttacctgaaataggcaaacaaatctgacactgtattccactgctttattctaattatttaacactaaacatttaagcaataaaacaagcatgacattaaatcactacgaataaagtatctactcacaacattttgtatatcttcacagtatcgttttaaaaacaaaaggacccaaccatttcacaatggctctttttggatagactaaggcagtctaaaaagatacctgtatggtttgaaccattctgtttgtgagttctagagcagccatcgctgtcgaggtaccaaaggaagcagcgcctctctgaaaccctctgacaatgcggccatccttccggtactgctctattgggagccagaccaagtcctttaggccttgtactacaacagtcaacacaaaatcaacatcagtgccacagttcagacttttctatcattctaaccctggggtttttaactcctaaaactggaggcaaagttttgtgtatatgagtacatatgtgagttttctagactaatggtcctcacataagttctcaaagggataagaattactcatctgaaaaaataacttatcttttgattaaaaaagaagaaaactcacctaattgtactagtgaatgcataggtccaacacctcccaggattcctggtagctggttcttcttaatgtcattaagccactcagtgattgcatatgagaataatttgtcaacgcctagtaaactagagcaaatgattattagtatgtcaaaaggagaaatacatttatagacacagattagtttgagggtttttttttacttaaaacaaattctacaaattataagggcaaatattacaggtgcttcaaaaacaggtaacatttttcaaatcaaaaagaaacacaaatcatccttttaactcacaacctgaatttctctaaatatacatatacatacatacacacacacatatatataaaatccaattctaatgttaataatttctacaagactcaggtaatacgtattagtgtgtttttccaatgttcttatttcttgaacatcttaaggctttggcataagattaacccaaagtttctaaattgccagtaattgctactaagaacttccaatcttttcactgaataagctaatttacaaccttagaaaattatttaaaatatcctaaactataactgttttttccaaatactactcttttcaaactacttctaatccctcagaatagaaatcagtgcctaaatcttaagagtcctctaaaaatgagctctctaaataaaatactgtaaaattgtgtatgcatgctaagaaaactcagtttttaaatttgttgtacactaactttgataacttcacttaaagcttcatataataaattcacttacccatgtcgataggaaagcctcttgagctttagttcagagcagtttaactgagccagaccaatcaaaatcccagctagcgtacccttcaaaattaaaaaaggccaaattaaccttactgtaaattaagagactcaacatctaaaataattgttattttgaaagtcaaagcagtagtcattattgatactaaaacacttaaaatatttacagtaaaaatatatatcttacaatacatatgacccaatttataccaaattttactcatggtacttaagtaaatatttacattaaaaacaattaaatttaaaaaccttgcacttcatttcaaacatatatataaactatgacaaagcaaagttaaaaataaaaacgagctcattagagaaacatatgataattttgtggagtatatttgtagagtttcccaacctgatccattgatacatgtttgccatgataatcaagtcgaatgggaacttctgacgtgaatctaaattctctgaagataaaggaaggagggagttatttacatttacaattactaataggtgaaattagatataaattaatttgttcaattggagaataaaaacaaaaccacaaaataaatcatataaatatcttaagaactaaataaaagagaatgtcttttagctctatcttttcctaatataacaattaaacagatgttaatcatctcatatattattatatttgcatttctcacagaaagcttttcttagttacgtctatatagtgtaggaaaataaaaataatactaacataaaatgtaataaaaaccttttctcagtttatgaaataatgtacacttacaaaaatttattcttatatatattcacaattcattcaaagaataaattaataaaagcaaccttcaagattaaaccagatagtcatgaccaagaaatataaagagaaggcctaaggaattattttgactgtctggtaaaacagagccagcaatcctggcatgaaccccaggttcatctatgacatgcaactgtgggcaagtcacttgaactctctgctgctcagtcttcagaaattgttaaaatgccacctacattgttaaattttgtgagaatccttgaaactaatgattctaagtaaacagaattatcgacaaacaaatatagggaacggtgtgagaatgaaattataattatacagttgtcccttggtttctgaagtggattgcttccagggcctttatggataccaaaccccttgatgttcaagtcccttatataaaatgggatagtatttgcatatatgccacacatatcctttcatatactctaaatcatttctagattacttatagtattaatacaatgtaaatgctgtgcaaatcatttttgtatttttaatttgtattatttttattgccttttttaattaatattttggttgaatctcagatgtagaattccagatatagagggctggttgtacactgatggtacacatctaacaaaatgatctggcttccaaaagttggctgcaaacaatgtttggaacttgaaacacagttttcccacagaattaatgttggtggttacatcctaagccatctcaccaaagtccactgcgcctacaacaaaatggagatgctatatttacaccaatcactaccagaagcctcagaccccaggtcacgcccatcccctgaatactcagctccacttggctgtcgggccagtgccctccaatactctcctttctcactttttttttctccatggcacatattaataggacaaaccatttattttaattatttgtaatctcaatttgtaaactcaattaaatattttctctactttgttcatttgtgcctagatcaaaacctggcatacagttaagtgctcagtaaatatttgtaaaatgaataaatgtttggaggaagggggctctcatgacattactaaaaactgtactggattttctggattagagataagaaaatctgtgttctagttgtgccttggccacgaactgtggtcttgagcaagtcaactaatctctctgggcattcatttcctcatttgtaaggtgtgtaatttagactatggcactgattaggagcctttgagagtacaaatgaaaatctataagctattctcaatattttaaatagtctaatggaaaaaataaacatttacctaagtaagtatagggcttgtgtactttttaaacgtaaataaatgggtaaccctacttcctctgggctaaaaaaaaaaggcaaaattctttgctttcaggcccatgtttacaaaaaccaaattggcagtttataaatgtgactaataaaataagaatgcatattatcacttaagatacatgtttttgtaaaaataaaaggatcaatgtaggaaattaattttaaaaggtccttctttggcggtggaaagatttagaaccaccaggaatcatctattccaagatctttccaattatcatattccattttttctacctattttcatcactatgcaaaatatttaaaacgtgacaacccttccaattagtaatactgctgactttggcccatgcctaaagtctaacttcagaacctagagagaaagagagaaatcagcaacccgggacatatgagaaagcagcacagaaaatcagggaagatgtaactgctcctcataacaagggggcactgatcttcagtcccttctctttcccatagggccaagccaccatccctaccatccagttttggaaaagaaagaagatgagaagaacaaacaggtctgtaaatgaggaaactgcagtgtgctgtgctcgagctggccgagccgttgggcagcagtcacagccgacggcagcagcacagcggacctgggtctcttaacagtgcccactgagcagggagggaagggtcaggaaagacacataacgactgggaagggcagacagagaaaataggtagaaaatccccacaagggaaaagacagacaggcatagccaggttgagatacataaaggaaaaaaagcaaaaggatgatatcctgctgggctggtacaaacacaccataacagtgctggaaagaggggacagaggagagaaaaagaaggaagaagctagaagaaaaggaaattcctgccagagaattgaaagagagacgaatttggaaccaggttactatgtgcaaataaggggggtgcaattagatggggaccacaaacagataaatacaccagctgatgatttggcagtgcaaagaaaagctgacggaacctcatgattaccagcacacatacatcacagaacaatcttcaaaagtctaaaataacttcatttgttattaaaactaaattagttacctaaaaaacacaggctgatccctaaaagatgcttcttcagcagagaagttcttctcttccatgccattaaccacttccactgaattggcactatcattttgggaaggctgttttggcccagagaaagaaataaccagatttggctcctttgaggtactcaaatgccttggcaaactgcaggtgacatcagctccaggagactttttaactgaaaatgtaatgtgcatgtttgaaaaattagatatgcttcttcttagcaaacatttaaatcaatcttgatctaatttgtttttctacattttatttaatcaaaatacgattcttgttacagagaaaatttgctttcaccttttaaattattacttttatataaacagtattcgcgaatcaacaaaaataaacacagaacacatttatgtaagtgggaataaatattgtaagtacattctcaaaaaagcctcataacaattaaaatcaatccaagtacttggtatagtcttttcaactatacatatttaataccttctggatctggagtcatttgaagctctacttctgcagaaagacttgtgaagaaatccttcaggaagaacaaagcatcctaaaattaagagatgtaattttaactaaggaagaaaagaatcacctatttctaaaactatgaaacaaagtatcttaaactcatatattttactcattgttcaaatatagctacaatttattgaattctttctccatgctagtcattattcctattcttccccccaccacacacacacacacacacacacacagatacacacttcccttttaattctcataactttatgaggaaattaatttataggtatgaaaactgagagacagaagttaaagattacaaaagtaaaaaggactaaatcaaagtacatttgagttttcttagaaatggagcactctcactcttggccctggctctcattctgcattgtggtgatattaccaacaatcatgtgctggacacttttttttttgagacggagtctcgctctgtcgccaggctggagtgcagtggcacaatctcggctcactgcaagctctgcctcctgggttcacgccattctcctgcctcagcctcccaagtggctgggactacaggcgcccgccaccatgcccagctaatttttggtattttcagtagagaccgggtttcaccatgtggacacttttaagtgtcttcaaagttccaaatgacttaacttctgcttttcatacattatattgccttaatacatttcatcattgaacatgatattcaaaataatgaaaataatccattcagtatggtctctcctgaaattacataattacaaacaaaaactgcatggctctgtcttcactttgtacgtacatgccatatttgcccattataggcagcttcgttttgcctatctcactcaaactgacaaatatatcttcgaggatatatttgtatatatgcctgagcctgatcttattctttcctttcataatcctaaactggccgggtgcagtggctcacatctgtaatcccaacactttgggaggctgaggcgggcagatcatgaggtcaggagttcaagaccagcctggccaacacagtgaaatcccgtctctactaaaaacacaaaaaattagccaggcgtggtggcaggtgcctataatcccagctactcaggaggctgaggcaggagaatcacttgaacctgggaggcggaggctgcagtgagcagagatcacgccattgcactccagcccaggcgacagtgcgagacactgtctcaaaaaaaaaaaaaaaacccaacaacaaaaaacctaaactaatataaaacattaatactgtgccaaaatgcaatgtgaagggtcaaaatatttagtggcacgccaaaacagtttgacaattccaaaagctctgtctactgatcacatatctcagaagtacaaatgatgcaaatgagaaggatatcctaggtaacatgcatatgggagactaagcaatggactgcagcacaagcaggtggtttcgtcagtagtggaaatattctgattctgaagcggggtagtgggttcatgaattgttcattatattgttatgctttacatatatattcatgtatgtattttatgtattatttccatcatacacatttaatatatataattcatattataccaaatattacatgtttacagtttaacagcatataaaatgctattctttggccactagatggtgatattttaatgccataaatggtgggactccatgattaccttcaaaaaaacagcaaattttcaggtatcaatttcctctttaaaaaaaaaaaagggagactaaagatacaatggtttctactcatttttcaccacaaatgcacaaaacaacagataaagagatgctaatcaccagctttttttgttttgttttgttttgttttgagacagagtctcgctctgttgcccaggctggagtgcagtggcacgatctcggctcactgcaacctctgcctcccgggttcaagcaattctcctgcctcagcctcctgagtagctgggattacaggcacccgccaccaagcccagctaatttttgtatttttagtagagacggggtttcatcatgttggtcaggctgagtctcgaacccctgacctcgtgatccacccgcctcggcctcccaaagtgctgagattacaggcgtgagccaccgcacccggccactaatcactagctttttaaaatgttctcaaaattttttgattttggtatttatgctaaactctttacaaatcagtaagaccaacaactcaattttattttattttattttacagatgggggtctcgctctgtcacccagactggagtacagtagcatgatcatggctcactgcagcctccacctcctgagttcaagcgatcctcccacctcagcctcctgaatagctgggaatataggcaggcaccaccatgcctggctatttttttttctattttttgtagaaacaagatctcactatgttgcccaggctgatcttgaacttctaggctcaagcaatcctcctgccttggcctcccaaagtggtaggattacaggcatgagtaacccgcacccgacccaaacaacccaattttaaaactagcaagacacagacacttcagacacacaaaagaaaatacacaaatggctaataagcacataaaaagatgctcagcatcacctgttaccagggaaatccaatttaaaaccacagtgtacacaaagcatcccagctaaaattttaagaacgacaataccaagtttggcaaggctatgaagcagctgcagctctcatggctattggtgggaatatgcaatgcaacagccactgtgaagaattgtttggcagcttcttaagagagctcaacatatacttatcttatgacccagaaattctactcttatatatgtatttattcaaccaagagaagtgaaaacgtatgcccataaaaagacttctacataaatttcctaacagctttattcctaagagccaaaaccatggaacaacctcagtgtgaaccagcaggtaaacagataaaccgtggtatatccacagcaaaatcctactcagcaataaacatcactgtggatacatgctacaacatagatggatctcaaagacttaacgctaagtacaggaagccaagtacaattccatttacatgaagttgcagaacaggaaaaaactaatctatggtgaccaaaagatcagtcagtagtcactttgggatggtgaagatgaactacaaagggacatgagtgacgtcttcacggtaaggaaaatgttctatatctcaactggggtagtagctactcaagtgtgtaaatctgtgaaacctccattgaacacttaaaagctgtgcattttagtgtatgtaaattatacctcagtgcaatcaatgtttttaaactttaaaaaattgtttatgctaaactttgactgtaaaatgtctagtttgaagatcctatgataaaggatattaatactgcactatgacttacagtgttaaaagaattccttttaatgtcatactcaagcaatgaagcaataatgatgaaaaacacaattgtgcaaactggtgctgctccatgttcatcctatagagcctggttgagcacttacttatcttccttagcagaatggtctcccagtcccagtccacaatcagagtaaggcttttggtatctttacaaaaatcttcacctgcctagctccactgcactccttaaggcccaccttgaatgtcaccacctccagaaagcctttcctgagcatccctcacccttccaaactcccagtctaggttaagagccatcttctggtcaggcataccatcccatgcctatctgtatcacttgtactcaccacagcacattaaaactatctcttttatgtcagtcttctataaagagatccttgaagatagagatgtcttattcatctttgtatccccagcatcctaatataaaacttgggacaaggcaggcattcaccaaatggtcttgaatgaattgatacgctttcccggcagagttccaggcagtacaaaactaaaatggataataggctagcagagtcaggaaatccggcccccttcctattttgaatctcaaactgcctagctgtatgacctccatcatccacttatccaccagatggaactcattccatctgcaatgcttactgcctgccctaagggaacactgagctttggaagcagttgcacttaccttcaatggcaatgcagctttttcaaaaacatgaaagaataatgtgttgctttcatacttaacatgattcaattaagaagaataagtggggatgtgctcggttagaaaaataatactcaaagcattatcattcaccaactgatttgttttcacaagaaaaaataaacaaaaatatttgattttctactcagacgaccatttactatcccaaaatatggtatagcaatcttaaaagaggcgaactgaaaagaatttttgtgtcaggtgatatacctcattaacgcttacatatttgtggtgtggctttgttttcctagcttttatgtcttaatgaattatttctcattcttcctcaaggtagtcataaaatttatttccctgatggttctaagattaataactctccactttaaaatcataatgctttatagttctaaataagaaattgtgttcaatattaaatttaaaagtctattaaagaaaattagggtgggcacagtggcttatgcctatcatcccagcactttgggaggccaaggtgggaggattacttgagcccaggagttcaagaccagtctgggcaacataatgggaccacgtctctacaaaaaaataaaaatagaaaattagctggacatggtggtatgcgcctataatcccagctgttcaggagtctgaggcgggaggatagtttgagcccaggaggtcaaggctgcagtgagccatgatctacactccagcctgggtgacagagtgagacactgtggcgggggaagaaaaaaagaaagaaaattgggcttgctaagtttcgtaaagtcatgccagaaagatgtatcttactcaaagtcttgttcacactggtgatcgccacagatcaattttcccacaaatatttcattgtatttccactaggccaatcaatatatggataaatttagttaaagtatggatatcaaaatatcttcttttcataatgataaaacataaacttaaagtactgattggcaagtctaacctaggtcagaggctataagcattaatgtagagctatgctaagcttctgtacttcacagtacattttctctaagacagcgcctattttttgtttataaatattatttaagctcagtcttgaaatatttgttaccagcttttagttattcaagttttatttaaacaactaatgaacattattcaaccagtactatttaagcaaattaataacgtccaccccacaaataaatactctacttccaaacctgagctcatatcaacacaatttctgtcaagaaggttttgttatttcacagcagattagttaaaaactccatttatgttctgcaattatcatatgttatgttattattaaataacaacagttaacattactgatccctaacctagtgtgtcaggcacccagttaatgtttttcacacactgatttatttaatcttcattttaaaaagcattatgatacacatattactatttctcccattttatcagtgaaggaactaaggcttggagatgttcagtaacttacccgaagccatacaactagtaaaagctacagaactaagactggaacccaggtctgactccaaacccatgcttctcgccattctattactataccttggctgcgcatcctattttcatacatcttggtaaaaagtttctggaagaggcaccagctatgttttaaacagatcgctgggtcaaagcaaagcccagaagaatttgatgggatgcctgctagaatacgggaaagtggatttcactgtgcccaactccagttttttttagggaaagtctaaatctctgttgtttctgacctctttatgtataccaatttactcatttgtcattttgcccagcacagaaagaattctcttccagatgctgcaatgaagacagagcagcattcaattcatcagggaatcctctaatactctctgaaaatgtatgcatatctgaactgggagtagagtacttgaggattagagaacaagaagcaggtattaaggtctacatcacaccatgagtaggagactggggaataacatctaatgatgttgactcagccatagttcagattccaaacatctaatgaatttgccctattctttatcagaagtttgctttatatatgtaaccgccataaaagttcaataatgataaacattacaatttctttattctgaacatgcagtctaatctaactgtaacggcaggaatcacgctcatgctacaaacctggtcaatattgaggcggagcggcatcagcgacactctcaagcagcactcctgtggggacctgccagattctggacacacgtgtaaggctttcactgtcaactacaaggcaagaaagagaataacatttttccccaataatatgatgaccttcttctctttaaaaataagaaaaaaaaagaaaaattcctattcctataccatatgagaaaaagaggaattgtttaccctctttccttaaaagtctgaatcaaacatttttgggtcacatgcccccatcaataatctgattaaaggctgggcacggtggctcatgccagtaatctcaacactttgggaggctaaggtgggaggattacttgagttcaggagttccagaccagcctgtgcaatataggaaaaccccaactccacaaaaaacaaaaaattagccaggcacggtggtgcactgccagtagtcccagctactcaggaggttgaatgggaggctagtttgagcgcaggaggtcacggctgcagtgaactacaatctgcactccagcctgggtcacagagtgagacactgttggggggaaaaaaaaaactgcttaaagatgtagactctctttagaggaaaaattgcaaatggataatgttgtacttagtaacagtttactgaaaccctgaagctaaccataggtccatatgccaaaatcaaattctgtgagggacctccaaagtcctgaaagaatcatttctaccttactaaaatgtaaagagtgttagaaatctggaacaccttcagcaatactacctattttgtactgatcactagggacttctacttttcctcagatatcaatttattagcaattagagttaatggaccctagaagtgacatgcaaaataattttttaaacataaaactttaagcaatacattcaaaagggacttttcacattaaaatgagaaaagatatctagtaattttccctactttaactctcctgaagttagatataataaaaacacgtttccaaaactaacataacacaacgatgaggttaactcttaccatgttggagtgagcttttcgaggcatttctttactgcaatacaggtataaaaatttattcatttgtgatgttgccaaacgatctcgaatctcaagatcctgaacaatgaacacctgccgggagactgggtgttctgagaggctggaatcacaatcaggtttgcatggcgggtagacttcatgctgaaacttcaccttaacgggtaaggaggaagaacgcggaacagttctttacattccttttattaaattgtattttctctttaaaatgcaaaatatcactcatttttcctctgaattctacctcagcttacaattccaccttcaaaaaactcaacaacatgacattccttcacttgttcactcatttattaatctacagtgctccctgcttgtccaaggttttgctttccacagtttcagttacccatggtcaactgaggtccaaaaatatttcagtattttgaaaccaagagaaataccttccatataacttttattttagtatagtgttataattattctattttattattcattattgttaatctcttactatgcctaacttagaaattaaactttatcataggtatgtatgtataggaaaaacacagtatacataaagttcagtactatttgcagtttcaggcatccactgaggctattaccatgtatgtctgtggataagggggactatgtggaccctaccatacacagagaagcttgactaatatttctatttgaccttggtaaaatcccttatttccaaggaaaattctcaataggaataagacataaaattattatcttgcatacctatgaaattgctttaaaatgaatcagcagaggcagggttcaagttccaaaaggaggcacagatatgattaaatacagggaattgtcatcactacaatattgccatgctaactatcctaaaatatgacacttggtacaatctcagacaagctggtagaattaaatgcgtgtgatgccatcagtagtctggccctactggtctctagtctcacaaaggacctgccagatgcactgtccaaacacaggctttcccagacagatgctctagggcagcatctcctcagtctgaccctacctcagacttcctgaatcagaaactctggggtggagcccagaaacctgtgttttaataagccctccaggggattctgggcttgctcaactgtgagaaccaccgctctagcggtagcccagacaaacaaaaataaaagaaaaacacctcagtcttcttagaacatttgagaatgaaaaagaggtaagagttttatacaagatccttgcacttttccaatccaaagggttgggacttaaggctcaagactacgtggtgggggataacaaaagaaccccccgccaatatcctacttaagtggatttttccttcaaatgccatcttaccttgcttagctgtatttccattaaaaagtcatggttccttccttttcccccacatactgtattacgtccatgtctcgtgggtgtgtgagaaggcgaactgtggggactactaaaaatgagcaaaaaaaaaaaaaacccttttgttaaaggaatattcaaagaaagtcaatgaatgacattaaggaaaatgataagatgaaagacaaagtaagagtacagagctatcagaacgctgccacaaattactagaaaccaaaaccgtatcttctttactctgtagacactgaaacacgcgtttcattattgccattagagtaatcacctgcttgctaaatactcaaaactacaggaaaagctaattatgatgctgggatccgtatcacaggatacacttagaaatgagacctccttataagcttcttgttactttggaaaccctttatagtcagaacacaagtcctaggaatcccaactaatacacaaaataattatagtaaagttggacgtgttttaaagtcgcttttaagtagaaaaagctgctgaactatagtgtcaaatgttactgctccacgcagcctccatgccatgccccacctcaataaggaagtctgccccctacagggattctgtccacctgattctcccagcgaccggcacactgcactcgtctcacaggcgctcaatgaccacaggctctctgctcagtgccctgctgaatgctggggacagggcatgcccgaccccacctcctgacacacttcctgcgtttcactgccctctgtcactcacatgactcacaggacctactcatttttgtgaaataggtacatggtagatacctgaaaatttctgctgaatgaaaatgatgagagtcaacattttagtaaaaatacaaataatacaaataagttcacaattggaaaactgtgagagtaacatttaaattacagtttttaatactactttattaataattcttaaaatgataaatcctatttttcttttttctctctaaaggggaaatggaaaattctatttttctaagaaaagaatatattggcctcccaaataaacttatatagaaattaacttacatataacttttagccggagaagtgggagggactattccaaaatcctttcctccataaagatgccagacaagagagacctccttcaccacatagcgaatcacaggaatgggaaagtgtaagggggctttgctcgtatcggtcttattaacgggcagactgaaataattgtctcttatcacaattgcatcatcaaccatgatttttataactggttcttcttccttctcctaaaataaacaaacaggtaacacatactctcttttctaattagaaacaactgattatgctgcacatctcaaggggcattcttgcttctacattctttttaataattccagtatataaaataaggtgatggttaccgacattagtcaccacaaagatattctgctttattaaccataaaataaactctctttgttctacgtaaaccactccataaggattttttatggtttacaattcggctttcactacttgtttgataataaaaaagcacaaatttagtgtgtgggtatttttttttgtttaaagtcaatactgcaaaccaaaagttaacaaatttcaacatatggatgatattaccatgtttttaataataggtttatcctgagtttgattgtttggatttttaaaaatttaaccagaaggttctcagaactttgtaaacaaatacggtcacctactggacaattcctggaaagtttccaaatacacatacacacacacacttatatctatacatacacacaaacacaccccaaccatcagccttcacacaaaccacatcttatctttcccgattcttggactagcaattctgtccagcagatccttctgccatttaatttcacgatccttgaatagtcatcttactatataaaaaatctggagttcaataatctatgttggaaattttgcaaatagcattcttctctgagtctttagatgtgtcacagaaatagtacagtaaccattcaccaactgtcaatagtatattaaaaaaaaaaaagtaactctgaactataaagaatttacaaaatcaacagaattttctccaggtaccctttggtcaattcatttgtaacaccattcaaggcttcaataatgttattaatttattacctgcatggctgcttttggtgcaaaaagaatgcaaaagtcatcattctcagtgggcacacctgtcattgcatcactgatgaaatggtgagagaatgaggcataggtggggccggactcctgggatacattcccactctcgtcaggaaacaggaagaggtctgaacaacatggctcctgaatttgagatttttcatccaaaacacctagataaaaagattacaacattttggcacactttgaaatatcaacaacaacaagcattttaaccatgtgtcagatatatgttgtgtgcttttacctgcaatatctcatttatttcctaaaataagtctatgaatctgaggcttaaagagagctaagtaacatgcaccaaaacacctcagcaagagtcagaaatacatcaaaaaccactaataggccaggcatggtggctcatgcctgtaatcccagcactttagaaggccgagatgggtggatcacctgaggtcaggagttacagaccagcctggccaacatgatgaaaccctgtctctactaaaaatacaaaaatcagctgggcatggtggcacacacctgagtcccagctacctgggaggccgaggtaggagaattgtttgaagccgggaggtggaggttgcagtgagctgacatcacaccactgcactccagcctgcgtgacagaccaagaacctgtcaaaaaaacaaacaaacaaacaaaaaacaacaactaataaaaagacaaatgataaattcgaaatggcaatgtcacaaagacagtttcctcccagttagttggcgttggggaagctcagcagttgctggttagtgttgagtggagttttgctttacccagaatttcacctttgacaattctgtcctataggcggagctctggaagaaacttcttggacaatattacaatgtgaggggaaactggttacatttagcagagcctaaatgtagggggagggaaggggaaggggagggaagaatagctgttgagcaagcattaggtggcagaggaggcagtgattcaagtatgaaaagaagacctcttcctggggcctgggatacccaaactggatacctaatcttaggtagctatcgcaaaagattacatgtgcaccaaaatctgcatgtcaacatatattttaatatgtttacattacatattaagagtcactcattcttttcccattcattcattaaaaccaaacactgtgatgaggctgagaacactaagctgaatcaagagacatactggctttaagagactcacagattagattttagattcttctacagcagtacctcagaattactcatccttacaggtacccagggcctagtacagaatcttgtatattgaagccacccagtaaataatcactaaatattctttcccatgtaattaaggtagctgcatatatacatatacacacacacacatatataaatatatataaatacataaatatatatatacatatatatataaatacataaatatatatatacatatatatatatatatatatacacacatatatatatatatatatatatatattttttttttttttttttttgagacagaatctcgctctattacccgggctggagtgcagtggcacaatcttggctcactgcaacctccgtctcctgggctcaggtgatcctcccaccccacctaagcctcccaagtatctgggactataggcgcctgccaacacatcccacatctagctttttttttttttttttttaattggagagatggggtttcaccatgttgccgaggctggtctcaaactcctgagttcaagtgatccacctgcctcagcttcccaaagtgctagattacaggcatgagccactgtgcccagcctagctgctaacatttattacaaataatgtagtacatagaacactaaaagccccagtttgcttccttagttctaatttatcctaaattagcaagacagcaacagttaacactagacttttacaactccatgaaataatttttaattaagatttcccaatatatagatatagctatgaccattcaattagaagaaaatactgttgaaatagaggctttaaaatgtttacctgcttccctttggctttcaaggatcttgaatcacctgggtccctctttgcttacccaactttattatctaattcttttcaataagagaacttttgtttcagtaagaacccgaatgtcatggctaaataactgaggctcatgcatgcctttgtctgtgctctgttgatgttaatgaccttgccaagattaccttctcctccctctttacatacctaaatcccaaccacttttaaaaagccaagccatcttactttactaaagtctaataaaattatcccaatcctttccaaacagtagaggatataccacagttgaagtattttcttacatcatttatcaatcagtctaagtactggcaccagttttgtgcccatttgttttactaggctacaagctaccagaaaacataagcactgtcttctactcactctgcattcccgacaccagcctggccagagttacctatttactagacactgagtagacacaagctgaatgattaacagatatccataaaaactcatatgcgtctttaataagtgacttattaaatttacgagaacacaaataaagtaagccccaacattaacatcagtgctccctgagaagagtcctggtcttaccattagcctgtggttttactgacgaggtgccttgttgcatgtcgatctcctccatagcatcactcatcagatctcgtaacatttgttgatctgcttcaggaagtactggaccacgtgaggatgatcgaccactggaatctacctatagccaaaaaacctaattaaaaataactgaaaatgctcttaaaaaccaaactacttacatttattttatcccaaaaatacattacattgtacaaaaacatcagaaatagaaacctactcatttttctatgcccagcagctgttatatttcaagtttttagtattatcaccctaacaaatactggcaaagagcaataaatgtgtcaccacctcaaagcaagcacagtgaactgggatcttgaagaggcaatgcatttgaaaacagggaagttgaacaaactgcaataaagctgggaaagaagggataactaaataagtttgatctcctcaactctgatggttgcaatgactttcatccctttgacataaagcccctgtaggacgaggcctcatttcttggacacctaacaacagtagggggcacacacagcaggggaaatatactaaacggtgattcagagctcagttccagcaccaaatacttaaccaaatacttcaccaatggttggtgaactgtagattcattaaacccagatcgtgctttttatatgtgagcatgactctaaaatagcaagttccaagctgaaagggataatttaaaataagaagaatgttttttaaaagggaataaatagtaggcggggtgtcataaatcaccttatcgtgagaatacagcaggaacaaggagtcacaaacagaaattaacacaaataaagtgtaaaataatcctgaacaaaagacaacaaacacgatgccagtcaggcctttactagagtacataacagaggctctagaacctaaggggactgagatttctgttcataagagagaccacaaagaataacaatgaaaaagaaaaaatgctaaacaaactggacattcttcaatttggacataagagaagttagaaaggtgacacttggggcagaaaagtgcattgaactggacaccaaaatatctgggtttgttgctgtttctgctactctttagagcaatcatctaaattctctgggtcttattaatttttaacctctctatctcaccaggtcatcatgaaaggaaaaggaagtcatatatgacaaagtacactgaaaactggattgtcttagagataaaaaaatagggaaaatatgatgatataagtaagtcttctggtaacaatactaacacctgccatctatcttttcatagcatttttacatacaacttgcatagaacaagcttttgcatgataaatgttttctttcttcccttaggacagatgaaaataacaagtctagaaaaaaaaaagtatgatgtttgctaggaagattaatggaaacaaagaatatcaaaacagcagaatggttttccaaaaaggcccatgaaaccaccgtttcagaccccattattctgaaggtaaagaacagatgaatgactttcaaagtttcttttctaccttatgactgtcatgaagacctcaataatgtaaacatgtcacgacatggcagggactggaggaatcacattgctgactgtaccttagaccttctttgaaaggctccaggcttcatatctgccttgttaggtgtctgcaagtcaccatagcttgcaatgtactgaatgagattcattaacgcagcacaagagtctgagcacgttctgatatggacaacatcgctggaacagtgtaactcaaagcggggctcagtctggacaagacacagaaaaagggatgaaaatgttttccaaatgagacaaaagtttctttttttgcatagatttacattaaataagattcatgataatctgtctcgctacataaaaaaagtatttaaataaatccatttttaatatacttactctatttctgaccaaaattaggtacacggaaaaatgttaaactcaatttttttaatctcttaaaaaatagaacttaaaattttcatttattttaataactcacttgctctccatcagaatcagacttcactgcagttatggttaactccaaaagccccatatccatcacacgaacataatctaaaatttttaaaattaagaaaatctcttcagtacagctttcaaaaatgtgtatccaaccaacacccaatacaactagcattcctttaaaattcattgcagagagcactacaaataattataatgcaatgaaaatagtttcatcccatagaagtcctaaaattcactttattttttgttagaaacaaaaattatcttaaataaaaatttgtagtatatatagtaatttgatgtacttaactagcattataagaacattacaatttcaaactgaaaaaccagtatctgaaaaatgaagctgtgaatatataccacatgatcactatatacttaaagaccctttaatctttaaggatctttaataagattcttagttcactagcattatcccagagttaaaatgctttaaaattatttacgcacaaaaataaagcagaatttatctactccatttgttttttaactcttacctctactcagatttatagtgacagtattgcatttgtcagatagatgtaaagcagcttcatccaagattattctgaggcaagaaagataaaaccaacatctgaaaaactaagctttgagtatcataccccataatcactatatgcttaattgcatcattctttctggtatgaacattgttgaaatcataagcagtttctaacttataactgtcatctaacattttttaaaaactgtttatgaatgctaggaatatttaaatggtgtaaagaattagattaaatcatctactcaaattaattctaaatttttggcagtttttaaagagatgcccaaattcacaaggtttaaactatagtataaagatagagtgggccagatgtagtggctcacacctgtaatcccagccgtttgggaggacaaggcaggaggaccacctgaggccaggagttctcaactagcctgggcaacacagcaagaccccttctctacaaaaacaaaactttttttttaatcagccagggatagaggcacacgtctatagtcctagctactcagtagggtgagggcaaaagatcacttgggctcaggagttgaaagctgtaataagctgtgatcatgccactgcattccagcctgggccacacagagcaagaccctgtctctaaaaaataaaaaaattaaataaaaagtataaagtgtatcaggtagcatgggaagtttaccatatgttttaaaatgcaaactttttaaagaatctccagaattaatttcttccctaaaaatgaaatgcaataataaatgggtagatgaaacatgtcacctgagaaaaattgggtaatttgggtaaaaggttataactattagtaaaagaacgtttaacaaaaaattgagactttaataaaatggtttaggtaaatatcaattggtatgtttcgaacagctttgtttagtatacaatgaagtttacacaggtacctgagagtagaggaagatttatccaatgcaacgctactggaaacactgaatgtttccacggtaagaagagatcggattggcaaataaaggggtctaatgccaaagagaaacaaaagaacatcagtttgatacggctccagaaactctattaaaaacaacaacaacaacaacaatttgaaccttaactctactgaattatgtatttttttcaaaatttagtagcattttaaataaaactttattttgttccatttgtgaacttacctataatcaagtgcacagctccaaagatgaacatgaaaagttgtaaatgaagttggaggattatatcccaaaacaggttcatcagcaatattcaagaagtataaaatctataatcacaaaaaattaaaacgccctgctttagaagaaaaaaaaggtttcatataatatccttaataccaatgtaaaccagaatatctcacagaaaaaatcatttaattggaaaatcataacggtaaaaggaaaaaaatcatcattttgaaggaattagtttcaaaaagtacttgcatcagaaaagaaggtaatggatactgatggatgtgttcgtttgactacaataggcattttactatgcatatcaagacatgttattcaccttatatataataaaaataaattttttaaaagtatttgcaaaattagaatttgaaatgcagaagcctatccaacaactccaatgctacagaaatcttagaaaatcacaccttatgaaattaataacaatgtatgcataatataatttcatattttttggcttggaacaattctcagaaaaaataaattttgctaaagactgcttaaaactatcaatctggcttcttatataactcattgtgtgcaggggcgattggtttttcatataagtcattgttgaaggaagctctttttccttaatgtatacctagctcagtctaaaaaccagtccctctcaccaacatctattctttcatatttctaatccaaacaaataaggaggttctgctaaatgtctcccttccagctggttattcaccctaaccacttctctactcctaccagatagaaagtcagacagatattctcatgtttcctaaatgctttcatgagaaaagaattttgaaaacactcaagtttttaaataatgtattattttcccagcacaattaagaagttctcctttataagaaacatgagaagcaatcatagtgcactagttttcattctcacataaggaaaagctaacttcttactcaaagtctcctctgaaaaataaccaattgtattttattaccataaaaagttgttgaactggaaattaatgagagaaatcctgataaaatgctttaaagcaacatcatattattggcctagggaattatatggaaatattgcacttaaagaacttctgattataaaagcaattcaacacaccattcactgctcctctacgccagacattctacaagtcctgggatacagagtcccttcccttcctttaatgacatataagataactctgtcattgagaggttttgaggaccacactttaaggtaaaaaaccaattacattctgaggtgataatactgttttgttttgttttgttttgttttgttttgttttgttttgttttttgagacagagcttcgctcttgtcgccagactggagtgcagtggcacgatctcagctcactgcaacctccgcctcccgggttcaagcgattctcctgcctcagcctctccagtagctgggattacaggtgcattccaccacgcccagctaatttttgtatttttagtagagacgggattgaccaagctgggctcgaactcctgacctcaggtgatccacctgccttggcttcccaaagtgctgggattacaggcatgagccaccgtgcccggccaatactgttctatttcttaacctaaaaggtggtgacaccgtagtattcacttaatgataattcactgagctgaacatttatgacttacaaacttttcagtatgtgtattagatgtcaacacaaatttttaaataaattaatacatatataacagctctcttacctgctcatgccagctaagcccagaaggaagcattctatgctggagagtggctcctttcagtcctacggcaatgagaaattcctatacagaacaagacaaagaatgacatttaccacctatgtaatcctataactcaaaagtttttccaagaaaataaatatgttgccttttatgtaattatttttagctagaatcaaatcaacagtggcataaaagtacaaaacacaaacctttgtattggactctgatttatcagacaatattttaacggcaacagacagcatattcaaactgtctcctccaactccatctgaagaagttttactgaggccatcttcttcagaggaataaatagtaggttccaaccagtgtgggcgggttgagctgggaagtcgtgtttctgtcgggagaatcactccattcactatgcctagagatccacattgaggtaaaaatagtaacaaaatgattacttgaaattagctaatcaacttacatgactcaaaacaaaaatccacgtacttccactgaatataacttaaggaggcatgatgacaaaaaccagcatggcattaataatccactcctctttgctaatgttagtgtgactgaccgtacacagcttaaagaaacaaaagattctgaaatgctaggaaaattaaatagaaaactatcacaaacatctcatgtctatgaaacaaggtaaactcaggtaactgctcaaaaaatggtaggttctatatctggaaccaaaaggaaatattccttaaagaagaataaagaacatatagtcccatcgactgatgaatggatacataagatgtgatctatctttacagtggaatattatttggcaataaaaaggaatgaagtacagatacaacttggatgaactttgaaagcgtgtcaaatgaaagaagccagtcaaaaaggccaaatattgtatgattccatttataagaaacttctgaatatgcaaatccatagaaacagagtgtaggttagtgtgtttacgggaaggagagagcggaaggggtgaaagtttatcactaaagtgtatgaaatttcttcatggggtaataaacatgttttaaaattgactatggtgacggttgcataactcttgtgaaatactaaaaaccactgaaaggtacactttaaatgagtatggtgtgtgaattatacctcaacaaagctattgcaaaaaaagaacctgaagttgacttctaatttgtaaatattactttgacagcagaatgagagccctccacagaaaataatttctaataccaaagttctgttctcaatagattttctttgttaaacaagaaatttaaacatgtctaaagagaagaaaccaagacacgtgtttgtcctacctttatggtacagactgaaactgctagaatgaaggcaaatgtagtgcttgtcatcaaaaccttcatattttgtcacacaaaataatgaaccactattgaactctaaccagaattcaccatgcttgttttccaacagatctccattatcttgctagtaaaaagatcagaaaaacacagaagttattacttaaatgcagaaaagtaagcatgttccttgagatgctctttgttgattcagcttaggaaaatctcccatactgcagcaaagcagtctaatccttgaactattcaatatcatggtataaaataaaactggataacttaaatgctatgtggaacctcttctatcagatgaatctctgtactttgttgtcaccccagaagcagaattagcacctgttttccaaagggagagccccacaaagtttgatctgcaacgaaagctaaatccccaaagttgctatcatcatggtttgccccaggacactggtcttcatcagtccctgaaacaacttcaaaatatcaaatacttcaatcactagatatgtatcctagcagatttatttaaagtaagatacatttgaaaaaacacttcggatttgtaaacctcaccttcacatctgtgaacactgctattaatccatgattaatattcagaagaactgagagaaaactctgagagttcttgttctgagagtctaatttttttttcctgcgagaacgatagttgggatcaacagtggaaaaatactgcaaagtctcctcctcagatccactttcctcatctatgagaaataaacatacaattacattctgatagcatattaaaacagcaacataaaaatgatcatgaaaatattttatataacctgcttagttttacaaagaatatggtgtgaacacagaaatacatactgtttttctctttagctttgaacttcaaacaatgtgcacactatcattctaaagagaacatatttaagtgataatgatattctcaatatacagatagaaataaggaaatattcttataaattactaaaagaaattgcaaaatatagttacaatgaaacataaagatttttaaatccacaattcaaaggttagtactttgttaattgataaactaggcattttaaatcaaaacaaattaaaaatatattaccatagtgaactgcagatttaaatgcactaaaactatctttgttgaaagtattaatgagctgactggctactgaaagcccaatgccataggaaatattctcgaatgtctccactggtgaaggagctgttggttcccacagtagcaagtcattaaagatcctataaagacaaaagttgaaaaataagtacttaactcctagttcaacagaaggcaaacttaaaaaaaaatccttttaaaagatcgtatgaacaataattttttaaacggcaaaatggaaattagatcctacaagaatttggaaaaacaacaaaaataacaactgcattctttcaatgaaaaaataactgatatggctataatgcagggcagtgacaaaagaatctgcacaattagatacctaaatagatacttgcctaattttacctatgttatatacatcaaattacaaattcatattacatttcaaaatataccttagaaacagaagctcatgaaaaataaaaacccacaaagaacagaaaaggaggacggctcacctatatgagagcactttgtaaactggaactgatcctgcatcatctcactgaccctcccctcagtcctgtggggtgtccagggcagaatcattattctcactttacacctgaagaaactgtctcataaaggttatgtgaccttcccaaagtcacatggctaattagtggaaaaatggggatgaaagtccagattatgtagattacatccagctcccaattcagttctttttttaaggcaagtatttatctgtgggatcaattcagttctttccctagaaatacctgatttttctctcatcagcaacagaaagcacagcttcactgggaagacttcatgagatgaagaatgcatatggagcaaaaaataaggagagaaaaacccttatgactagcgagactagcccaatcaatactggcaaccaatgggaaggcatatgtcatacctaggctgtcaccacatcctactttttcaaagaactacctgtcactgctcagatgcccctgtcctagcctcctcccctcatccatcctcgaagttttcaagaaaactcaaacttcaccacgtcttctagtaaacccatcgtaagatctggacccacagcatatgcttcacacagacccacttaaatcacagcacctacagcaccctcctgaattttctcgtttcccctttttagactgcaagccgcccaagagagggacttgtgtcgatcatctctacatgtgcctagcacagtggctgtcacataacaggcacggacagttggtgaggacagtgaatgattcacatggaagtgctgccaaaacccagactcatcgtaaagcctggtgtgaataccggtcaaggcgccgcgtggtgaggcagccctgcccccttctgtgagaagccactgccaggacaattcttgagcttctgaagtcctagaaggtgtacaccaggactgaggattgtgactctcaggagattataatccactcacctattatgttctccttatttatattttggtctaaacacagtcttgataccattagtactatcgaatattggatggtgcttgtagtatcaagaaatatcaagaaagaaaacaatgcttaagatacataaggacatatcaccatgactctgtgtctatgaggctgaaacaaaatagatgctcagtacatatttaatgaaagcaattagaattcttttttatattctattttaaacaattttcgacacagaaaacattctcctgtacctaaaaccatactgctaaaaacagcctgttgaccaaggcactaaaggagtaaatcaacattttaaatatataaaggcagagttggttataactcctgctcagaaaaaaaaatgaaaaataaaaggatagtattgacatattaagtaaaacttgaatggggtatgaggattatatggtagtacgtatccagtttagcttcctgcttctgagagctgaattaccagttaatgtagaatgtccttgtatgtgggaaatatgcattcaagtactaaacattgaagggactcaggtcagcaacttactctcagatggttagggcacggggagttcttcgtactgtaaagcaaatcttctctgagaatgtttgaaaattatttaaacagtattaatttgaaaatacaaagccggataaggggcaaaggatgcaaaccctgaggaagttagatatgagatttatatgatcccagaaagtgagggagcgcttcagtatttatgcaattctaggggcctgagagaccaaaaagtggttagtggaaggtatttaatagaatagaaactctcttaagcaatccattaaaccaactatccagattaacagatacatactctaatacacgattctaatacatactccctgacttaagcagtcagctacccaattacccccaagtgccacaacaacggaagcccccaatatgctaactgcctgctgttggtggacatctctctagtagagctgagaactgttcctatcagtggagttatatatttcatatactcgccaaagaccaactgtgtctggcttcaaatctgcttgtatttgttacttttaagtatagtttaaataaaaactgtaccgttttaattaatgcagactggggtaaaaaaaaatcttaaaaacctacaaagattctcctcttacatatctctgaaaaaatttttttcacttcactttaaagaaactggaactaaaaacggtagacaatgccttctgggtacactttatgcaaaaaaaagacaaaatagtcagatgccacatgcaggattaaaaaaaaggaaagggggaaaaaaagacaacatagaattccaatcagtggctcatattcaaagaaaaggccttgtcctgtatttagaaatgaagtggtaaataaatatacatttataaagtgaatgtttaaggtatgtattactgttcttgatgccctgatttaatcaaaagcaatctgctcagtcaatgcagaatgagaaaaaaataggtcaagtgtttttgatctctgggctaggccttgaaagagtcatttcatttccctcaatctcagccttgcacatacatcagctctttgcggacacccctgaactatgaaataaaaggaggagcctagagatcagtcattttgaaactgtagatcatatataaacaaaccccaacatttaaaaccaatttgaaacctctctaatgtgaattgaatatacattaggtgctatttataatgtatattataaaacaaatataaaaatataaattttaaaagattatttttaaagttaaacgtaagtgataacattttcttcctataccagagtggactgttctctgaatctcattttcaagaccactgaagtaatgtgaaccctagaagaatcctggaacttaattttctgattctaagagcaaaagtcaatagcacccagtgagaaaacccagggtttattactaacatttaaggaataaataccgagtggtatctgataccaagtaaacctacagcagaaacaacagtctgaagtttctgaagattaatggaaactagaataacttgtctacatgtaggaagctagtgatgacaaacactaaggacttctttttctagaaacccacatgacaatctttcaggtatgctacggagaaatcccttcagtgggtaggaattataacagacaaccactaagttcttacgatatgccatacactattctcagaactctccaagtgttatatcatttaatcctccaaacaacccttataggtgggagccaggatcatctccattttacagaagaggatgctgagtcttacagaggctagataaactgctcaaggccttcagagtctatgacctagaattccattagtatcaaaatacctgcctggcataaatattgaggggtatctaaatataataaatttaaattttgtacacgttcacagaattttgaattccaacaagatatctttttgaatgctgaagaaaagatgcttcttgtacaatgaatggggttctgattctactccagcattggctagctgtattagcatctcttaactcttcacgtcactgcacataaagaaaaaaattgtatttgatcggtaacctgcagtaagctgacagagggcaatcagccaacctcagggctgaggaaataaatatctcacacacccggcaccacgctagttaggaaactctgctatgacaatagcacatcataacggcaatagtcaccatcaacaccacacaaagtacacagagatggcatataatattcaggcaaggaaaggaaagggggaagaggaaaatcagggaggcaattagaaaatctgattccaaagattcaactaaatgtgtataaactcacctattataaagcttctcataaaagctcttattaggtagtgttacataaatatttggtaacgtaagttccagcacatagtgagaattgctgattgctttatcctgaaattctgtcatttctacagggtctcctggcatcaccatctaaaacataatagttcagtgcaaaaaaaaaggcatccatgtttaaaatagtagtagcatcttcttagcctatccataggacttggtatgtgagaaataaataagcatgaaacatttaactagagaaaatatacaccaagaaaaaataggtattattcaattttgaagtttaagacctagcaaaaacagtacacaaggcatttttttaaaaataaaaaatcaaaagcattgctctatgacagagaataatagtattattcctttgtagcttgctcacacttttacctgttcattttcaaacattactctacgagaagaaaaaggagatggggctggtcttcttagatcacaaacatctttcaaggaatgagcacctccttcctcttcctcctggtagtgaccatcattctcctcttcttcttcagctgcaattctctccaaaatggaatgcatggctggtggatttattttcagtacaattctgatagcaaagacaattttaaaaagaccaagatctaagtgtaaacagcaaaactttaacttttgtgcaaattaatacacacaccactggttaaatcttaatgatagaattaaacttctctacaaagtctaattatgtctaaggtaacccacttatgaacatgttgtaaacttacaagtgtggaactgaaacaagtaagtaacagaaagacataaacattttatacttgggtaactgaagggggcaaaaaggttatttttaaatttcattaaaagtcagcaaactttacctaaggattctagttatcattaaaccaaatcttctcacatatagtctgttctgctataataaattacttgtctacctaagaaacctcatgttatatcaacctcatattatatcagttgttcaaagggaaaagggagaagctgattaggaaacagtttcaaaactctaacaacaaagttatgttttcatctagtaatttcaataataaagggctggtgctgtttctgttttataaccacaaaacctaaagatcactgagttaatgcagcctatgactacaaaaactaatgagctttttactccagagtaatccctttcctaagcttctacagaacatctctagcacagacttttcattctcctttgattaccacatccacccattgttataaggaggcatggaaccctcaaagagaatagctgtgctgcaactgcaactcttattccctaggtagtggtgttatttggtttgtaaatgatcacaggcttttttcctaattgatacatatcctaatataaattgtgcttctgaattatttaaccgaagtagatccagtccttatgaaacttgtgctctaaactcatgcttattaccaggtgtgtatgagcaacatctgtcctaagaatctaatcggtctaatagacagtggagaggaggagtaaagcaaggcaggcagaaaaatagcacaacaaggtttgagggtgacacatctcacacattcatgtgaacacccaatcatcacgcttatgaaccacaaaagaatcaaggatggacatgtttagcttatatttaatagacaaaatgttggtttaaaagaatattttatttttaaaaggaaaatcctattaaacctatgcatttgcttactcaccgtggccagtcaaagtcatctgacgatgttgtatctccatctactccactagacacatggaaaaacttaatagatggatctcctttctcttcctggaacgatcctaaaaaaaaagactgatttactgaaatgtgcttcttctcaagtactaaaagaagagatggaggagcaaagatcctctcaatcaggaacataatgcaaccttaagttctacagcatttttcagttgttctggtttcatgtgcacgtgtggtagacagaatgagccaataaattaaagattctgttttgtgttcaaactcaaattcttaagtaccaaggtacactgcataaagtacataatgacatagtaaatagagcaagcacttaccacttactaagtgctattagtgattatttcttcataaagtctatataatctaccactagaaaaataactacatttcttaaatatgtattttgtaccaaacactgtaagaaacacctctgttcaaaataattctacacgggctgggcgcggtgactcacacctgtaatcccagcatttgggaggctgaggcaggcggatcacctgaggtcaggagttaagagaccagcctctccaacatggaaaaaacccgtctctactaaaaaatacaaaaattagctgggtgtggtgacatccaactgaggcacgagaatcgcttgaagccaggagatgaagattgcagtgagccaagatcatgccactgcactccagcctgggcaacaaagcaagactctgtctgaaaaacaaaaacaacaacaacaaaaattctatacgtgttttttcaatccattttacaaatgaaaaatggctttcctccagaataatgagtttctcaccactggagataagggatgatctcacaacacctgaaggccctttcatgaagtcataattgacaacaatcaattttaaatacctcttaagatacgtaaaaccgagagagaaaagaaggggaacttttgcaaactattctcatgaggggtgggagtgtggttgcggagagagggtgtcgtggcagaggcaggtggtctaggaaccacaggataaaaggttttccaggtcttcatagacttggttcactttaaagtttttataaattcccttcattaactgacaaaaacaaagtaatgcagaaaaaatcaaaacgagttttacaaataaaagtcactagcgattagttagtgtaatggttgaaagctcaagctccactgtcagacttgggttcaaatcttgattctgccattgactacaacatgatcttggtagatacttccttctaggtccacagatggtctcatctattaaattataaaaataactggaaaaataaacatatggtgattatgatgactaaaaaaacaagaaaatgtgtatcaagtgcttagcataatatttaacatacagtggcacttaacaagttctattatcagtcctacaataaataaacgagaggtggtaataaaaatgtaggctaaagtactacactctcctgcagtaaacaggaattttaacaaagtgaatgaatcatcatccttagtttttaaaaaattacctatatcacatatttgcatacaatactagaaagacattgttgctgttgattttaacataatgttctttaattgtactatattgcagggctgtcagatacttttgtgatgttaagtttcagtagcagttgtttgttatctaggatggttcttttacaggcacattcaatcttaccaattagttctctaaaggtaagttccaatttaatttgttctggggttgatcctcctataaattcagtcttaaattctagatctgtgaaggctaaataaaggatctccttctgaagtgacttcttaaaccatggtcctctttcttgatcagatcgaagatcaggtattgggaagcgaacagaaaggtttaatgctggtgtggcaacttgtactgatatccgacaatttgcaggactatgtgaatcatctagaaacacttcagtgaaagccttgtgctaaaacacaaaacatcaaaaatatgccaaaatattaaagtaaatgaacataaattacacagtattcaacattacaatatgtataatcactatctccccatttggtataatgcattaaaagtcaattcaaattaaccactaccatattaatttagtgtaaaaaaattttataatgcaacaactattagcaaaagtgaaaactattggcaaaagttaaactctgaaataaaaaattaaattaaaaactgagccaaagtgaagacaaaggcactatatattaatatttatcttactataaatttataaagaatacggtgtaaattagcctaccaacaaattcaatacggttaaaaatcactgtagtgtccaacattcagtttgaaagacttttctaccaatatatgattttaaatactcaatgtgaaatcagatgaattatgccaaatacaatcgctgactcaactttgtacttctaagataaaacccagaggctggcacatcacaggttctaaataaatattcactaaatgacgcactctgagctcctatccaatccaagggtatgatctcatcaaatggttctatgagaccaagatatatgcaccattttacccaaagccatcttacaataaaagggtcaaagaacatcccattcaaatagaaatctatttctattttttctctaaaatatattgaaactaaaaaagctttattccactctacgttgtaacactcctcagtttcttcaatcaatttctaacctccatgatttgaaaactccctgcatatgctagacttacaatttttgtgtttgtttttttcgaaacaggtcttgctgtatcacccaggctggtctcaaactcctgggctcaagcaatcctcctgcttcagcctcctgagttgctgggactatgggtgcaagccaccacacccatccagacttggatttttaacaaatctattctaactctccccatttgatttgctaatatttaaccaccactctcaggcaaaaataacccaacagattaaaccatcatccaattgcatatatagttacagctaatatacagactaccccacagaaactaaaataactagcaattgataacaataacaaagaatgcccagcctgggaaacatagggagacaaaatataaaaacttaaccgggtgtggtggcacatgcatgtagccccaactatttggggggctgaggtagaaggatcgcttaagccaagggggtcaagactgaagtgagctgataccgtatgacagcactgcggtctgggcaacagatgtctgtctcaataataataataataataataataataataataaacaatgctaatttgatgtgaatactcaatactaagagaaaagcaaagaagtagaaaaataaaatatctttttccttttctttttaactaaggttgtctccatctgatcctggtcctctggccccaaaattcctaacagacttcttgcaaacttgactgatttaatttgcttagaaaagaccccaggcaccagatgcaagtaaaagtgatataatgtgatgttcaatagattattttcaaaagtatatcccatattgtttgggcttcatgttttaggtagttcaagtaacttatcaaatgtataaatagataaaattttataaagtcgttataatcacagcttataaaaactctgatagacatgaaaagtaaaggaaacctaattccactgtaatataaacaatgctactgactggcatatttctcgccattctttttctatacatcaattttatttacacaggtgtgacaagtttatgtaaagcaatatattctactttttcatttaatccttgatgagccttcttcatgttgttataccatcttcataaccatcattttctttttctttttcttgagacagagtctcgctctgtcacccaagctgaagtgcagtgatgcgatctaactgcaacctccgcctcctgggttcaagctattctcatgcctcagcctcctgagtagctgagattacaggtgtgtgccaccatgcccagttaatttttgtatttttagtagagacagagtttcgccatgttggccaggcttgtctcgaactggcctcaagtgatcctcccacctcagcctcctaaagtgttgggattacaggtgtgagccgccacgcctggccataaccatcattttaaatgaccacataacatttcattcagtgtgtctcaaaaacttatttagctagtctactatcaagacataaaagatgtctcctttttttattattacaaataatgctattttaattatactgtttaatctattaaaaatacttaagttcagaaattatctcaataaccctattagctaaccataattatgattagtatttgcagcttttgaatacttaccagactaatatgtttattatatgaagtatacatgtgggatgccatcatctctactgtggcaagtttctgtggttgaagcaaggaatttaacctgtccacaatactgatatccagctcacaacacactggatttaatttaatttgcaattctgccttgtgaggaactgaactaagtcttgcttgattacccttttaaaaaaaaaaaagaaaaggcattaatacaatcactaaaaactactatataattgggttaaaaccttataattgtgacaaaatatatatcagattaaaatttacaggtggcaattatagaaaaagatctcttacctggggccctctattctcagaatgcttataatgaagctgaagacacacaggggaatgggaaccagtttcttctttggaatggaacgttaaaagcttaaaagtaaagatgaagataaattaaatgtattaatcacaagaatttacagaggtgcccatacaataatgagaaaggctttctgaagtcagaaatctggttttaagtttcatttttgtcacttactagcaatgtgaaccttagacaagttagttaactcatgtgatatctcatctgtaaaatgtaggcgaggattcaaataaattcatttccaagaaagtgtttttgaaataaaacactataaagggtcaaagtaacagcaatgaacataactttgacagttttctaaagtttctttaggtcacacttttacattaggaaaaatatcagaaaaatggtgaatgaacacaagacatttaacttgtcttaaacaatgcttagcacacagcaggcattcgataattatttgttcaataatcaaattcttctgaaatgaagagtgctttgaacatgagtgaaatgaagtcatttctctcataacccacctgtcactcctaaacaagtcaactctaatttaaaattctaacagatccttataacgatgttgagtgacattcttaaatatatttctatagaacacaagtgcaaaaagaaaatgacaatattcctcctatggctttctatacatttttaaagaaaatcattgcctcatacaatcattaaaaagcaaggtagatttaaaaaataatcttaaagaaaaagtattcaatatttacctctgtatagtgaggaggaacagaatgaaaatcagttggaaataggcactccaaaaattccatttgcccaatggacatatcagtactaaaatatcgggaagctgatctttgtctttgttcataggatactttaatgccagtacctataaatctattataaaaaatgcaccatttaagattattagtgttaaaatgtaacaattatccacctagtctgacaagttcaagttatcaataattaatactcctaaggaaattaaccagaaagattgcttcaaatttccctttccttaagataaaaaatcagttctgttgatgggaaattttccaggatctgtttatttcccaacactgcccttcgtcttccacatttaaaaatttacattgcaaaggcaaaatctttcagatctgtaaaatatatgaaatagtctcttaaaattatctaaaaacattatgcaatatttcaaaaactttagtcggtgaagcccaaatgaggtctacctatattttctgccgcttttgttctattttcctactggcagatgtttgaaactttgtcaaaaatgggaaaaaaaaaaaaaaaagtccaggcacagtggctcatgcctgtaatcccagcacttgaggaggacaaggtgggcggatcacctgaggtcaggacttcgagaccagcctggccagtatggtgaaaccccatctctcttaaaaatacaagaaaaaaaaaggggggtggaagaaaacaaaatgtttttacagtttgagtataaatactataatcctaacctgtagagtttttcttgtattaggtgtaaaactacttttcatatcaattttcatactttaaaaaagttaaaaagattaaataaacgcccaaagtattttctaaaaatactaatatatgatatgtttaaaccaccgtataagatgtcattcaacaatttatagatcactttcacattaaaattgtaaaacagagtttgcatgttaacaatactaaaggctgggcgtggtggctcacgcctgtaatcccagcactttgggagaccgaggcaggtggatcactggagggcaggagttcgagaccagcctggccaacatggtgaaaccccatctctactaaagatacaaaaactagctgggcatggtggcacatgcctgtaatctcagctactcaggaggctgaggctgcagaatagcttgaacctgagaggcagaggttgcagtgagccaagattgcgccactgcactccagcctggacgatggagtgagactctgtctcaaaacaaaaaacaaaacaaaacaaaaaaaccaactatattacaaattcaattatctcctcatctgttaagactcaacccatgaaaggatcactcactggctatttggatagctttgatttttcttaagcagaagttgaaacgtagcatccaagtttcaggatcagccttggtaatgtttcccaccccatggccagtggcatatggatcagttccaatagtattattttatttttcatcaccactgtcatctctgctaatgccagtgacaataagaactgttttcacgactgcagtggtgtcaatagggatgaaggcaaaatgtggttaaagaaacttgacaagagctgggcagggaactaaagagatcactttgaaaactcctattatctagatctgttattctgcatgccaaataacctgaatgaaagattctaaacacctttgcagcactgcaagaaaacttcactcattccattcatttacaaataaaatgtgaattagaaaaacaaatgcagataggcagatacaaaagtccacatgtggttctttttcaaggatcattagcatatgtggaagtttaaaggatcattaatacatatgtgagagtttacctaaggtgatcgtgtgagcaagcttctgcaaacactgctcggaaagacttaaaatcttctgttgaaaatcttgctggatcaatcttttctatacaagtaaagaaagctactgccataggtgtcaatggattaaggttctgtgacgtttcaggtggagataaaggatcaatgtgaagcacagagattgaaaaagttcccacagctagtctaaaaataagttcaggccttgattcatccactgaaacagatctagatgggagagctaaaatacaagtattaaaattatatacataaaatttgacacataaaactattaaaattataaaacatttactcatttattagctttaaaaaacagatgatcatacaacagtttgaatgatattaaacaattaatttaagtaaaatcaactgctatcttgctgcatcttacatccaagatttttgtactaaagtacaagagtacgtgacaacagtaaatgtacaaaccaagcttttatattaataaaaacatactggaaaactcaagattaaccaaaaactgctcaccaaattttcctttaagccttgggtctatatcaattaaattttgcagaaaagaaacctgaggttctcttccaaggaaaatgtaaatagtgaaacaaaaatcacatgattgactgagggtcctgaactgcaataataatatgaaacttacagtgtacttttaactaaaaatatttaagtatttaaatacacaaagaatacaataaatgagcaactattctaaaacacttcacagtgaattgtttaacaatggttcattttgctttctgaactttgtaaatggccaagaccagaaaaaaaaaaaaaagaaagaaaagcaccagtagaatggcattttaaaaattccagcggaaactaacaacaaatgtcttatttttacttacatgtcttctgtaaaggtgttgggtgaactaggttggatggaaatgttgaccctcttactggctgttctttatgatgatcaaggaactctccccaagtgggctgaagctataaaagattttttttaagcacatgaatgaagtgtagaattttagaagcaacttttcagtctagaagaaaaattaagtaatactttaccacagtagcacttaatggagatcctgctggggtatttgtatatgtactagttaatgataactcaaggtccatgtttggggggtccccaaggggtggaagagaagagagactatgagacatgtccatatcagccatggagaagaatacttcttcttctagagagaattaaactatgtcacttgtattataatcccaccaattcaagtcttttaagtaagttaatatacgttaatacaatcctcttccttcagattatatgagatacagcgatgccccaaattttatgttacttacagtggtgtaatttatgagtccaaaatattaatggcatagtaaaaactcaatataaattaataaaaaatgaagctaccctactgatgaacatgttttcttttgttttaaatatataaatgtagtattacctggtatatttttaatgtgatatgccagtttaggaattaaaatcagatattaaaatagtataaatatattgcaacctctagtttcatctggatacagttatttcttttattcagagccaaaaacattatttggaattccatttacatttcagttccttctttcggaattgttttactctcatgcaaatgaagtttattatggccaaaattttttgagtagggtttgatttcttattttgtccaacattccatacttaaattgatccatattatttatgttattagcatttatacattgtgaaacacctataaatgtaaagtaagctgggtagagatcattatttacatataactgatggaaagatcaataaaggaaagtttccttattaaactttagtagttcagtagtttcttaatctagaaatcattacatgagcacataataatttgacaaaatatataactacctaatttaactttcacataaatttacatttttataaattggttttccttagactaaatcatttagaaaacaaaactacacaatcaaaatcaaaaaaatatactatagcacctatgtgctggtgcattactgtaatgttgtgattagattaatcgtaaattaaaagttgtggatttcttacaatgtggatctttttgttctttcattcctaaacttctgttcacagcagccaaaattaagtgtaattttatctatgattataatatatgattctggtgtcaacagtttgagttgcttaccacggctagaaggtgtacgagctgtttctgtctcataaaagctttgctctgaagatacacccacagagagggaatcttttctcaaataataccggtttaattccatctgaattcgatactcgtcttcctgctgcatgggtcgatttttcctatctttattagctaaccctattttgctagaattttctataagcatacaaaaggaaaccaaaacagtaattaaatttggagttaattaagcatttctttcccaaaacccatttatggaacaacaatggcaacttaacaccacagtgcaaaaccactgctatttagtgagtcagagctctaagcaacagctttaagcaactagccaggaatcccaaaatcttatcgctgatagatagaagccattgaaaatattttaaaatgtgtaccacttactgtgttcaagaattatactttctcgattgtatgaagtactatccccaaccaaagaagtcagaacaattttagaaaagttaagaatgtgacacacataatctgaagtgaatatgtcccatggtaacacattcaaaacacccaatcaaattttactacttaacattcttatttgcttctttcaattcagatattcaaaaataatagactttcctacatgtacatacattacatattttaaagttttttaaaatttaaaaaagtaacaagtatatataataacagaattatacttgcctggtccagcaatagctgccaacatatccaaaagcaagtgcacctgtcttggtgacaggagtagatgaatagagtctatctgtccatcaacatccaacttaagggaaaaaaaaaaactattcatgaggagtattctttataaccttatcaccataaacgtcagtatattttaatgaactgagatgaatactgagtctttagtcttggagtccttcatctgagactctctctactaattcacaccatctaaatgaaaagacttaaaggccaccaaactgttgttctaaaaggaaaaaccctcctgagaaattccatgctgacgagtccaatgttatactttttgtctcttcaagtcttctgagtacttaaaagtatttgaggaggacttaagacatagtctccaaggatgaatattaaggtagcaatagcacagtattcattgactttcaaaagactgaaatcataatccttaaagtctgattcacatcaagaacaaataaagttggctttcttaagtacactaccaatcatactctagcagagcatgtaaggaccttctcctccaacactgtgccttcccagtacctactgtggtccacaaagcccgctctgcatgcaaggggacgccactacagaaacgtggacagaagatggtgcttaggtggacttcctttctcttttccaactctttgcccacttttccatctagaaataaaagctccatcccactctcttgatgattcctgaatactctgacaaaagcaattactttattctctatattacattctaaaaagcagaatatccctgccttacttttcattcgcctcctcttaacactgactcctattatttttatgtcattttgcaactgaaaaataatagaattaacaaaacatttatatctagaaaatgacttcttcccaggagaaaaagggattccttctgattctaaaacaaaacaaacaaaaaatcaaataaactacataatgattgagaaatttcgatgacctaagaaatccagtaaaataaatcattattatcacttttatttttagcattggggtaccatgctaagtgcttttatatatatttcctctaattcttattaatgttcctgttttataggtgaagaaatgagttcacaaagattcagtgaattgcacaaggcccatgtagcagatccagagctggattttcacctaggctgacctggaggaaaagccctcactccttccacggcatggctcccttgttctgcccacagacaacttattttacggggcaccttcctgactactgacatcccaagccatgagccaacctaaggctgagaggagagagaaaatgtgtttctaactacatgccaaatttaaaaattgttttataatttcacaattgttgtactgaaagcacaatctctgactttcattagaatggccaatcaagagtttcatttctaattcattgaaattaaaattttcatagaaatatttcattatttgtacattctaagtttggcataaaaagaacaaagtacttactactttcttttgaaaatataaaagaacataactaaaaaacaaatttcaactcaatgtaacatggtaactgaaacaaaacatctctaaattcaatacgggcagtctccaattttcaataaaatgcattcctaaaaacataggctaaaactgaatacatgaaacacagacttacacactactcaagggaatactattcagagaacttaaaaaaaaaaaaaaaacatgaaatctttcataacattttgaatccacagttgaaagagttaaggctaatgtacatcagaaagagattaaagatctgacattttcagcacccctaattaatgccatctttatctacactatattttatgagatctatgtttctcaatactaaaatccagaacttgtctttttccatttagcatcatttgcattaaataaaaacaaattatactcaaatactcaagtcattacacaaaaattactctataggcaagggtagtacttctaaatattaaatattggctggcacacaatgccactacgcagtttttccacatgttcatttgtcactaatatacagaactctaaaagtaacatatatttatacatttgtacaaatgtatacataatgttttattataaaagacatttgtacaaatcaacacatcatgtacaaaagtttgggtttacataaatataaaagcatacaaatgttgaggactacatataattaaccaaaacagaactataaaagttattgctatgcttcctccttacagacatggcaaatgcattccccagagacataaacatattattagtatagtttcccaaggatgttaccacagcagaggattccctgtagagtttacataatcttttgactacctgttctgctaacaatcccaacatgttacttgtaaagggccttttgacattgtaaaaggattttgcaccatctgaagaaggacagagcagtaaacagaaggggcctgagtaatcagtaataggagtgtcttcattctactttcctcctcctccaactctagtcagaggttccaatccaaggagggatttccggagattcttcaatcctctgaaaaatcattttatgtatattgacatgtacttagtggctccctcttctgtgtccccacagcaatttccataccccttactgtatcttttaccaaggcaaagattgtatctgattcatctttgcatctgtccgaaaaactgggacaggtaagtggctggcatgtggtagtcacttgaacatctacaactagggagatcagtaaataaacaaatgaataaatccgggtatcttcttaattaaaactacgttttatagagattatgtagaaaatttgttttcaaggtgtgaaaataatgcttgacaaatacatttttaactaagtaaatgcaagtttcctggttctccataagactgatcaatatgattccctaagaggcaaatatagttgtatttatacagtgtctttatacagtgtcaaagctatgagaaggagaaccctcatatgcttttggtgggaatgcagattagtacaaccactacagagaacagtatgaaggttcctcagaaaactaaaaaatatgtttttgtatgctttgtcaaagatcagttagttgtatgcatttggttttatttctgggttctctattctgttccattggactaagtgcctatttttataccagtaccatactgttttgctaactacagccttgtagtataatttaaagtccagtaatgtgataaccccagatctgttttttgtttagtattgttttggctgtggtgggctcttctctggttccatatgaattttagggttgttttttctagttctgtgaaaaatgacggtattttgatgggaattgcattgaatatgtggattgttgtgggcagtatggtcattttcacaaaatgcattatttccatccatgagtatgggatgtgtttccatttgtttgtgccatctattctttcagcagtgttttgcagttttccacttgtagagagattcagctccttggttaagtatatgcctaggtattgtattttattttattttattttatttgcagctattgtaaaagggattgagctcttgatttgattcttagcttggtcactgttggtgtatagcactgctactgattcgtgtacgctgattttgtaacctaggagtttactgaattcattgatcagatctaggagcctttttgatgagtcttcagggttgtctaggtatatgacatagcataggtgaacagctatagttagacttcctcttttccaatttggatgtcctttatttctttctcttgcctgattgccctggctaggacttccagtactatgttgaatagaagtggtgaaagtgggcatccttgtcttgttccagttctcagggggaatgctttcaacttttccccattcagtatgatgttggttgtaagtttgttatatatgtcttttattacactttgaggtaagtcccttctgtgcctattttgttgagagtttttatcataaagggatgctgaatttcatcaaatgcaaaaccataaattggttaaaacaccccctattcaataaatgatgctgggaaaactggcaagccacatgtggaagaaagaacctggatcctcatctctcaccctatacaagaatcaactcaagatggaccaaagatgtaaatataagacttgaaaccataaaaattctataagaaaacattggaaaaactcttctggacattggcttaggcaaagaattcatgactaagacctcagtgaatgcaacaaaaacaaaaataaatgggacctgattaaattaaaaagcttctgctcagcaaaagaaataaccagcagagtaaatggacaacccacagagtaggagaaaatatttgtaaactatgcatccagcaaaggactaatatccagaatctacaaggagttcaaacaaatcggcaagaaaaaaataatcccatcagaaagtgagcaagggacatgattatatatttctcaaagaagatatttaaacagccaacaaccatgaaaaagtgttcaacatcactaatcatcaggaaaatgcaaattaaaaacacaatgagataccaccttactcctgcaagaatggccataattaaaaagtcaaaaaacaatagatgttgggatggacatcgtaaaaaaggaacacttttacactgctggtaggaatgtaaacttgtacaactattatggaaagcagtatggaaattccttaaaaaactaaaagtagatctaccattcgacccagcaattccacagtgtgtgtgtgtgtgtgtgtgtgtgtgtgtgtgtatacatatatacacacacatatatacacatatatacacaaacatatatatacacacatatatatgtatgtggtgtatatacacacatgtgtatatatgtatgtggtgcgtgtatatatatatggtgtatatttatgtggtatacatacacaccacatacacatatacaccacatatatatacaccatatacaaatatatgtatatatatttacacacagtgaaataccactcagccataaaaaggaacaaaataatgtcttttgcagcaacttggatggaactggaggccattattctaagttaaggaacttaggaatggaaaaccaaataccatatgttctcacttataagtgggagctaagctatgagaatgcaaaacatacagaggtatataatggactgtagggactcaggaggaggggaggttaggaaggaggtgaaggataaaagacaacatactgagtataccgtacactgctcaggtgacaagtacactaaaatctcagaatttaccactaaagaactcatctacgtaaccaaaaaccacctgtatcccaaaaacaactgaaatttttgaaaaaagaaaacaaagggacaacaacaaaaactaaaaatagaacttccatatgattcaacaattccacataaggtatatacccacaagaaaggaaagcaatataccaaagagatagctgcactgccatgtttacagcacactattcacatagtgaatatatatgatatatatgaatatatgctatatgtgatatgatatatatgaatatatgctatatagaatatatgatatatatgaatatatatatcatatatgatatatatgaatatatatatcatatatgatatatattcacacacacgtatatatattcacacacacatctttgtgtgtgtgtgtgtgtgtgtgtgtatttatatatatggactcatcctatatatggacccatatatggaccaaaatatggactcatcctacatatccatcaacagatgaatggataaagaaaatgtggtatatatgaacaatggaatattattcaaccataaaaaataatgaagtcctgtcatttgtaacaacatgaatggaactagaagccattatgttaagtgacataagccaagcacaaaaagataacgcatgttctcactcataggcaggagctaaaaaaggggatctcatgaagattcccctactcacgaagagtagactgatggttaccagaggctgggaacagtggggaaatgaagggaaaaagaatataaatatactgattatcacttaacttacacttaaaaatagtaaagggtcctggtgaggtggctcatgcctataatcccaacactttgggaggctgagcaagaaggactgcttcagcccaggagttcaagaccagcctgggcaacatagtgagaccctgtctctacaaaaaacataatacaaaaattagccaggcatggtggcatgtgcctgtagccccagctacttgcgaggctgaggcgggagggttgcttgagcccaggaagtcgaggctgcagtgagccaagatcttgtcactgcacccctgcacccctgcctgggcaacagagggagaccccatctcgaaaaaaaaaaaaaaaaagaatgaaagatgatatattatataggtttattttatgtcaaaaaattttaaagctatgagacaatggaaaaagtctatctcttttcacaaatattatacaactatataaaaatggtcattctgttcaaaatagatgggtagatatttttacatacatataattataaaaacatcttctacagatttcttgcttgccaaatctcttttcctttaaacttaattttatgaaaatagaaagaattttttaaataaattcctagttatctgaactaatgaaaccatgtttaataccaaaaagagaggtttgtcagtttcgaattgtcggaatacgggagagtgagtgtagaaggcaactctttataaaacttgagctgcaacagtagggcaaaggcagtcctcacataaattttgtgacctaggatagaagcatcaactgagagtaaaaatgctaactcggtgacagcagtacactagttacaggataatctgcagtaatcaatcagtgaatcactgcatagaataaagaatacttgtacttttattttggttttactacagaaagtgaaacaaacactgaccttagctccaggaagcacttcattctgtttcaacgtgagactcaactccaacctaccaattaaccgtccaatctgcactgggtcagaaggtgctatctctggtaaatttctagttagctgtgggtgtggctcataaataattttggggttccagctaggtgagagctttggctcagtttcctacaataaagtgacaaaaataattatttaaaatactttcatataaataaaatgaaatgtaaaatataaatgtcaacttaagaagaataaaatatttgacatgtaaaactgtatgatgttacaatggacaaaccagtatcgtatagctaaaatgaaacacagtccactaaaatgttagcacagtccactggtaataaaagcaagtcatgaaaaaggacttcatgaaaaaaagcacagtatctgttcaagttacagcagtaagaaaacctaatgggcactgtataattaagaaaatctgatttgtaaaataacaaaaaaggcaaattatacagtgactgacttataaaaggactctcctcttggaagggatttaacagagttccttaattataaagctttttaaagagatgatttgtagaataaaatttcatcaatacagtcactatgtaaggtaaatttgcacactgcttaatttcctctgttttgattgtaaaaaaaaaaaaaattagacgttaatataggctaaacatctctaaaccaaaaacccaaaatccaaaatgctccaaaatccaaaacttttttgagtgccaacatgacactcccacaaggtcaggaaaatacacctgacctcacgtgatgggctgcagtcaaatatttgtttcatgcacaaaattattgaaaatattgtataaaattaccttcaggctatgtgtataaggcatatatgaaacataaatgggccagacgtggtggctcacgcctgtaatctcagcactttgggaggctgaggcaggtggatcgcctgaggtcaggagttcgagaccagcctggccaacgttgcgaaaccccgtctctactaaaaatacaaaaattagccgggcatggtagcatgtgcctgtaatcccagctactcaggaggctgaggcaggagaatcccttgaacctgcgaggtggaggttgcagtgagtcgagattgcgccactgcacaccagcctgggcgacaagagactctctccaaaaaaaaaaaaaaaacaaacataaatgagttttatgagttttgtatttacacttgggtctcatccccaagatacctcattatgtctataaaaatattcaaaaatctgaaacacagtcccagcattttgaataagagatactcaacttctacaccattttcccccaagatacagtacccaacatttctctttcaaactaatacacagcacactggtaggaatataaatattagtattttcaaatctctgaaacatatattaccattactgaatatttgcattaaatctcaagacagagattcattaagacatattatacatcctagcaaaatttaatagcccccatttaaaccttttaaaaaatctatgattatggttttagggtttttgttttttcttaccactggtgcagttgaacacactggggaagatttggctgatgcagaaaactcatcccagaagagagacactccagagagctgaagtaacttgtgagcaaaagcagtgggttgatgcacattaattcctgaggattcgtcagcagtttcatcacagtacacagttctgaaatttttttaaaaagcatttacaaaaagctcctaggggtgcagcgcaccagcatggcacatgtatacatatgtaactaacctgcacattgtgcacatgtaccctaaaacttaaagtataataataataataaataaataaataaaatctcctaggaaaacctatttacaataagaaacgcacatagcttttttaagttaaggggttttttcaagtgttagcacttcttagaatatgcctataatatggtcagtctcaccatgctttactaccataaatattttcatgaagaggtcttaactccaaaaaggtaactttatgaggcttaaattgagagaaaaaaattaataactcccttaagttagttttaaggaaaacaattcctgtactcccccacaaaacatctcttggtaacagtgtgacagcatttggctccaagtcacaaatgacgtttcttgaattcctatatgtgactaattttcagtttaaacaaaacacataaggtggttctaaatgcatgaaattttagatttttttaaatctactatttaaggcaatggacccttattccaaagatctgctaacaataactgttttactaataggtgttttgtgaaagacagaaatcttaacacagctgcttaaaattcagtagagacccccagtagatccatgtacgaagtgtctctggtgctcatgcagtgtacacgcttcatcctgctcatttctgttggcagttcatacagcattaacacacgggtgaccagttactgcctcaaatcaatgcttaggtgtatgtatgtaaattaaccttgctttacagctatgtataagagcttcaagtgggcatatgcaaaaaactaaaagcaacgtacttatatttttttaagtaaatattgcacatattaaccttaaaataatccgtagaggatcctcaaaacagtggccttagcctttctcactaaagcagcacttagattaagcacagcaaaacaaaaatgtctttcacgttaatgaaatatgcctaaatattgcattgttaatatgaaaaaactgaaactttcccacaggaaagccttaaattcagtggcactcaaatgcttattattctgatctgatattaactaaaacagaataacttgctttaaattcaacatggtattatatataattataccccaactggcactttcaagttttcaataagggaattagaataataaaattagcaaataacttgaagagcagcactttactctgaaattatgcaatattttcatatcattagctctaatctccaaaacctccctgaaaatgtaatatcagagttacaatagggtcatttattttcagacataagaattcttacctttctattcgaatttcaagtgcagttccagttttggaattttctggcacatgttcaattctcaaaacagtatctataaaagtgacttttactcttcttagtactaaagtaaacaagtaattgtcaacgtaagagaccacatatatgctaaataaaaacctccaaagaaataaataagtactagtttgataagaacttttgtttacaaaataaagaagctgaatttctttccattaaaatccttaaatcctgagttttgtaataaatattttgtcttactgagcacttaaccatgttacatctcaacagatgcttgggacaacgactaacactatctgttatattctaatccattcactatgcaagcataataaatggagaaactaaggtacaaaaaaaaaaacaacatgcaattaaatggaatatttaaaatacctcaattctaaagttctgaagtgggaacagtaattcttttaaaaatccattccaatggatttgccttatacaaagcttattacatgaaggtacaaaactactaaatcaaatctaaatttttgaaaattctcagtaacaccaaacctgtttcaatggtttcagcaaacttttcaagtccttcaaaaggctgggatccttctccttgttcatctgttagtttctggctaagacattcttttgccaattgcatactgctggtcataaaacttgaccaatacataggctcagaaccagttgctgtggaaaatataaattaatcctaaataatttcttaagagttacaacaatgccagttcttaaaataatacatttcaaatagacaaattcttaatcttttaagagatttttaacatcatgatgttacccaggtaaacaatattctagaaagtactcttgagatttaaaatcaccttataataaccaagaaggaaaaaaagatcacagaaaaaagtccagagaatgtgctctcacaacatgttatattttaccaaatatcaattcatgtattcattcaacaaatacttaatggatatcctacagatgcatggaactgttctaaatattataagcaggggttgacatacttttttctgtaaagggtcagacagtaaatattttatattttgtgggccatatggtctgtatcacaacttctcaactctcatattatagcacaaaacagccattaaagtaaataaacaaataagcatggctgtgttccaataaaactttattaacaaaaacagacgacaggaccaatttggcctgcaggttatagtttactaaccctgctgttgaaagtagaaaaaataatagtaaattctgccctcagagaacctactatatagttaaagaaataagatacgattagtagacaactattgaatgtcaacagaaaacattatgaaagctaaaagaagaggttaattcttctttagttaattatttccttctagctgagaaaattaacaggaaatgtggcagaagtagtagatgatacaggctttggaaattagtatatatgtagataaaataaaagagcatccttggaggaggaaacatatgagatgtgaaaaatcatttccagatcttccctcatgagaaaattctccccacacctccctacattattcaaagcaaagtgacagagattgcaagaattactgccttccaaaatggaatttaaaagtctttctaatggaatgctttaaagagaaaaatatttgaaagtttgccttcccatagaaaaatattatatccactcatcatagttaaaagatagaatattcttgtaaattaaatgccagattactaaagacgatttccatgcatgcataatcggttttcaaaatacagagtttcactttaattctactaaatataatttaaactttcatgttttgggcagtacttgggattataattctgtcattgcataccaacatacctgtcacctagattgtcaattctatctaattctatcatttttttctctatttataagtagctattctgctataaagaagagcattccttctccctgtccaccttacatactgatttatctgtatcagtatggtcctagagattttttatttcatgtgttataaaccattattgtcatcattctttgtaatactcaaattttcccaaatatggccaagggaagccccctgacactcaatcctgtgtccctttaacatttttccaacaatctttgagcattcttctttgctttctggcacaatactttttgaatctttaaaacccaagtctcattttagataactgataacaaataattaaataaaccaaacaatctgtatactaaagtttctgtgaaaaatcggggaaagaaacaactctaaatttgtaaacatgcacattctacaaagagccaagtcgtaatgtattatcaactgaaaatttcacaaatacaaagcaaaaatactaaatttaaggtaatcaggttactttcccagtctctgaagaataaaaacacataaaacagaaacatacaacacaccaacctgggcgaggtctaggccggaagaccatttctaatcctctcacttccagtgcacaattatcctgcagtaaagagccccatggaactgacagggaaattgactgaatgaatccttcagtgacttctaagggtgcatctgctgactccaagatctcattgagacactaaggagaaaaaacaggttcattatgaatcacaagaacaagaacacaaagttgtgaacttattcaaaggtgtcaaatatgcccacacatgttaggcactaggtataaagaaagcagagacttccacaagtacaggcaatcaaagcaaaagtggacaaatgcttctgcacagcaaaggacacaattaacaaagtgaagggataacccgcagaatggcagaaaatatttgcaaactatctatctgacccaggattactaatcagaacatataaggagctcaaacaactctacaggaaaaaaatctaataatcctactaagaaatgggcaaatgatttgaatagacattcctcaaaagaagacataaaatggcaaacaggcatgtgaaaaggtgctcaacatcactgaccatcggagaaacacaaatgaaaactacaatgagatatcatctcactacagttaaaatggcttctatccagaagacaggcaattaacaaatgctggagaggatgtggagcaaaggcaaccctcatacactgttggtggaattgtaaattattacacccactatggagaacaatttggaggttcctcaaaaaaactaaacatagaactactatatgattcggcaatcccactgttaggtatagcccccaaaaaaggaaatcagtttatggaagagatatccacgctcccatgtttactgcagcaatattcacaatagccaagatttggaagcaacctaagtgtccattaacagatgaatggataaagaaaatgtggtacatatacacaatggagtactattcagccatgaaaatgaataagatcctgtcatttgcaacaacatgaatggaactagaggtcattatgttatatgaaataagccaggcacagaaaaacaaactttgcatgttctcacttatctatggaagctaaaaattaaaacaattgaactcatggtgatagcagaaggatggttaccagagggtgggaatggtagtagggtagcagggatggttaatgggtacaaaaatatagttaaaatgaataagcccaagggccaggcatggtggctcacacctataatcccggcactttgggaggctgagacgggcagatctctcgaggtcagcagttcgagaccagcctggccaacatggtgaaatcccgtctctactaaaattacaaaaattagccaggcgtggtaggacgtgcctgtaatcccagctgcttgggaggctgaaacaaaagaatcacttggacccaggaggcggaggctgcagtgagccactgcactccagcctgggcgacaggggactccatctcaaaaaaaaaaaaaaatgagtaagatctagtaattaatagtacaacaaggtggctacagtcaataatttattgtacatttttaaatatctaaaagagcacaactgaattatatgtaacacaaaggataaatgcttgaggtgatgcataccccttttaccctgatgtaattattaggcattgtatgcctgtgtcaaatatctcacgtaccccattaatatatatacctactatgtacccacaaaaattaaaagttaaaaattaaaaagaaagcagagaccaagataaagatgatctcggtcctcactaagcttacaagatagtataccatgaaagagacaagtaattaaagtgtgatgattatatacagaggaaacacactgtgctatttgaacacataatagaacctaacctgcagattcaaggcagcccacttgaaggagtgctattttaagctgggaccagaagaccagaaggagttaatcaggcaaaatggtccaggcaaaaacaaagcatgtggaaggattcaaagaaagcagaagtcaaagaaatacatgcaggcatatttgatacatcgcagtatttgaaaaagaaaagttgctttaggcttcagtgtgccagggcgaagacccagagacaaggctatgtagataaagaggagtaggatccaaagagccttgtaatgcatgttaaagcgtctgaaatttatcttaagggtgatgtgaagccactgaagggctttaagcaaggacgccatgatgagattcaaactttgagtgggccccttcagttgccatgtacagcatgaagggaagatgccagcaggaaggctgttatgagtaatagaagctagagaggctggtttggcacagatagcaacactgaggacagtcacaagtggataaatttttgtaacatatttaggaagtagaatgattaattggcatcatgaggggtaaaagaaagaaagaattatgaatgacacttaggaggctggcttgggcaattgcttagatagaggtgtcatttactgagatacagaaacacagggaagcaggttagagggaagatgagaagttcacttccaaagtacacatttaaggagacatctaggtagaggtgctaaggaggaagctggagcttcctccagctagagctcaggagagccatctgggtgggagatacagattaacattacaaacacagagggtaggtcaggtatggtgactcacgcctttaactccaacactgggaagccaaggcgggaggatcttgagctgagcagtttgagaccagcctgggcaacacatcaaaaccctgactctacaagaaattcaaaaattaaccaggtgtagtggcacatacccgtaatcccagctacttgagaagccgaggtgggaggaatgcttaagcccgggaggcagaggttatagtgagccaagactgtgcccctatactccagtctgagcaacttagtaagaccctgtctcaaaaaaataataaaataataaacaaatgggtaactgaagccacagcacgaggagagaaatgtttgggaacttatacagtgtaaaatgagaggtggcttaagacagaactcatagacaccaatatttaagaaaagggttatgaaagaggagcctgcagaagaaactagaaaaaagcaaacagagacatagaaggaaaattgaaagaggttcatgtcccagaaaatcatggaagaacaacatgacagagaagagtggtcaagctcaacaaaagctaacaagaagtcaaagatttttaaatgtctactgaaatcagtaatatttaaagtactagtgatcccattaactgcaatttcagtggcatggtggagcaaaccagactacaacaggagacagacagaaagaacgtaaatgcgatttttaaaagacaatttacttttcaaattaaaataacatatttattaaacgccagcttatatgtaaagtgcttcctgcatgctatattgcatagggtagtataattctttgtctgtaccctagtgttgaatagtgagacttgatcggctcgttttatttttggagatcactactttaaaaggctttcttcatgctgacatttgcataatcctaaagactttcccagtagtacatgggcatggatggttttaaggtataagcatccaaacatattctttcctaaaatggactgagaagactacagacagtggtggcatcatgctgggtctcctgtcccatagttccttgtacaatcttccttctcccatttagccaaaatagccatattcttcctctcttcagaaattctcccttatgtactgtctaaggtataaaaacctccagacagggccagcagtacattttctatcttttcccatcttatactttttttggcatgacactcagaaattcaaagaactcagtgatgttgctcctgcaaaatctctcaattctcatctactgatttataacatcagtatttctcaagcttgtatctacattttaatttagaataaaatgtgtgccgagccctgctgaattccagctataagtatattcacctatggatgcactaacaaattagggaggaggggatcacaaccaacctctatcattaagaaatttatttccagtaaaagtttttatgtttgctgggtacagtggctcatgccagtagtcccagcaattttggagactgaggcagaaggattgcttgagtccaggaatttgagaccatcctgggagacatggtgaaactcgtctctacaaaaaatacaaaaattggccaggcgcagtggctcaagcctgtaatctcagcactttgggaggctgaggcaggcagattgcctgaggtcaggagtttgagaccagcctggccaacatggtgaaaccctgtctctactaaaagtacaagaattagccaggcatggtggcccacgcctttaatcccagctactcgggaggctgaggtaggagaatcacttgaacccgggaggcggaagttaccgtgagccgaaatcgcgccactgcactccagcctgggcggcagagcaagactccgtctcaaaaaaaaaaaaaaaaattagatggcatggtagcccgtgcctgtagtcccagctccttggcgggctaaggtggggataatcgcttgatcccaggaggtcaaggctgcggttgagctgtgatcacccactgcacccaagcctgggtgacacagcaagaccttgtctcaaaaaaaaaaaaaagaaaaaaaaatttttatgcttatcaaaatgcataaatttatactgttttgatcaactatacacttaacaataattgtaattacaacacaatccagaagaaaagtaacacttaaagccccatgattatctgaaggaaataaagttatgcatcacagaaggacatctggtcaatgacagaccatgtataggatagtggtcctgtaagattataatggagctgaaaaattcctatcaccttagtgacatcgcagccatcataaggcaatgtagcacaacacattactcacatgtctgtggtgatgctggtgtaaataaacctcttgctctgccagtcataagtctagcacaaacagttatacacagtacataatactcgagggtgataataaacaactatgctaccggcttctgttttaatacctatactatacaatttaatcattattttagagtatactcctactttaaaaaaaaaaaagttaactgtaaaacaggctcaggcagttctttcaggaggtacccagaagaaggcattgttatcataggaaaggacagctccatgcatgttactgttcctgaagaccttccagtggaacaagatgtggaggtagaaggtggtgacattgatgatccttaccctgtgtaggcctaggctgtgtttttttgcgtcttagtttttgacaaaaaagtttaaaaattaaaaaaaaaaattaaaaatacaaaaaaatgcttatagcataagaatataaagaaaaagtatttttgcatagctgtacaatgtgtgtttaagctaaatgttattacaaaagaaacaaaaagttcaaaaatttttttaaagtttataaagttactgtaacctcaggttaacttattattgaaaaaaaaaagatgtctttattaatatagtctagccgaagtgtacagtgtttattctagccgaagtgtacagtgtttataaagtctacagtagtggacagtgatgtcctaggccttcacattcactcactgactcactcagaggaatttctagtcctgcaagctccattcatggtaagtgccccatacagccatatcaatttttatctttttaaaatttttattttttatattttatgccatatttgtacataccttttctatgtttagatacacaaataccattgtgtcacagttgcctacagtattcagtaacatgctgtgcaggtgtatagcctaggagcaataggctgtaccctatagcctaggtatacagtaggctataccactgggtttaggcaagtacactatgacgttcacacaacaaaactgcctaatgacccatttctcagaacatatccctgtcgttaagcaacacatgactgtactgataaaatgaatatagtaagccctagagcaaccactaagaaacaatttaaaaatacatactgggctgggcatggtggctcccacctgtaatcctagcactttgagaggccaaggtgggcagattgcctgagctcaggagttcaagaccagcctaggcagcatggtaaaaccctgtctctactaaaaacccaaaaaattagccaggcatggtgacatgggcctgtagtctcagctactcgggaggctgaggtacgagaatcgctggaacctgggaggctgaggttgcagagagccgagattgtgccactgcattccagccagggcgaaacagtgagaatctgtctcaaaaaaatttcatattttatatatatatatatataaatcattaaaggaattaaaatgttacactagaaaatatttgcttaatgcaaaagaaagcctaatgccaacagaaaaaatttaatataaacaatttcaatttatatgtttttattgtagagaaatggcagcatgatcaataaaagacaagcataaactatataaattacaatggaatcttgcaaagtaaaatggacacaggagttcaatggaaaaagacacgatgttaaatttccaactttaatgaagagattgttcaagcattttttaacggataatgtgtacgatttttaaatcccactggatgaaaaaagttatattttaatatcaatatttaaacaagttattctctacaactatttaaaattataataaaaagtaagtcaattttaaacatacaaggaatatgtagttttttaaaaaaaatttcagagataattgagcaaacatggttaaagaccactccttcatttattttttccaacttttaagttcagggatacatgtgtagtacatccaggtttgttacatacgtaaatgtgtcccatggtggtttgctgcacagatcatcccatcacttagtattaagcccagtatccattagctattcttcctgatgctctcactcctcaccctctgacaggccacagtgggtgttgttcccaccatgtgtccatgtgttctcatcattcagctcccacttgagaacatgcagtatttggttttctgttcctgcatcagtctgccaaggataacggcttccagctccatccacgtgcctgcaaaggacatgatctcattcctttttatggctgcatagtagtccactgtgtgtatgtatactttctttatccagtctatcactgatgggcatttgggttgattccgtgtctttgctattgtcaacagtactgcaatgaacataagcgtgcatatatctttataatagaacaatttatattcctttgggtatatacccagtaatgaggttgctaggtcaaatggtatttctgcctctaggtctctgaggaatcgccacactgtcttccataatggttaaactaatttacactcccatcaacagtgtaaaagcattcctttttctccacaatctcaccagcccgtgtgttttgtttttgttgttattgttgttgttttactttttaataatagccattttgagtggtgcgagatggtatctcattgtggttttgatttgcatttctctaatgacagtgatgttgagcttttttttccacatttgttggtcacatgtatgttgtcttttcagaagtgtctgttcacatcctttgcccactttttaatggggttgtttttttcttgtaaatttgttaagttccttacagatgctgaattttagacctttgtcagacggatagcttgcaaaaattttctcccattctgtaggctgtctgttcattctgatgacagtttcttttgctgtgcagaagctctttaattagataaccatttctcagtttttgcttttgttgcaattgctttttgcttcttcatcatgaaatctttgcccatgcctatgtcctgaatggtactgcctagattttcttttagggtttttatagcttggggttttataattaagtctttaattcatcttgagctgatttttgtatatggtgtaaggaaggggtccagtttcaattttctgcatagggctagccagttctcccagcaccatcagggaatcctttccgcattgcttgtttgtgtcaggtttgtcaaagatcagatagttgcaggtgtgagaagcccactcctttaaaacagcatatgttcaggttacttactagctagctgggtggctctgaacaaatccttaatttccaagtctcaatttcctggtccataaaatagaaatagtaactccacagagttactgtgaccattaatgaggtaatatatgtaaaactaccaacatattaatagttcctggtactaagcaaacactttttaaatgcgggccattggtctttatctttcacagtacctacctagtacaatgatgagctctataaaggaactcaaggtgtgcttgacaatatgaaaaaaaagcaaacattaaattatatatttcttcttaatacgtaattccatagattaactaggcaaagaatacatctttattagtttaaaccaaggcatcagaattcaaatcgagataagacagagcataaaaacgcgcatgagctggctgagggcggtggctcacacctgtaatcccagcactttgagaggcagaggcgggggaacacaagatcaggggatggagaccatcctggctaacatggtgaaaccccgtctctactaaagatacaaaaaaatttgccaggcgtcggggtgggagcctgtagtcccagctactcgggaggctgaggcagaagaatggcataaacccgggaggcggagcttgcagtgagctgagatcacgccactgcactccaacctgggtgacagagcaagaatgcggctcaaaaaaaaaaaaaaaagtgcatgagctaatttagattaacatttcatcagcacctactacaaacaggacactagagtgtactattttatacctacatttacacctgcattaaatcttcataataaccctccgaattaggtatttttgtgcctactttacaaatatggcaattgaggatcagaaaaactaagtaacttgcaaaaggtcttcaattaatcactgcggaaacccacaaaaaagagaaatgtattttcacatggaagattttgcaggaggctaagcaaaatcatgtgttaacatatcataattttttttaacgtagtactggtttgggggctggctcatagaacaagcttttaaaacgcaatggaaaaactctccattcctttagtgcaagtatttttaaaaatgcagtcaaggatcacatgtatcagaatctcctaggatgtttattaaaaatgcagattcttgaatttctagagccaaaatctgtatggaaggggccagaagcctgaatgttagcaaattcccaggtgaacccagtgctgttatgtctgagaagctcaagtttcttgaatctggggcagtgtggtgtacaaaaaaaaaatataaagtcagaaagacaggtttcaaaccttgctgcactgtttaatactaagcttgagtaagttatttaacctcacagtaaacagaaagttagtacccaatttagagtaaaataatgtatgtaaaagcacccacacagtacagtatatagagatggaaggtatttaataaatgatcattattattttcaaaagtaaactaaaacccctaaccttgctccatgttccccctagccatcaaccccattttctctgtcaaggtagttatctgctcaaactgcaaactacaagcgaccttctaaccctcagctcctctgaaactgcttgtaaccaccattaaaatgacaaatgcaataaacaatatttagtcctcatctttattgaattctcatctctacctagttcctaggaccactcaccttttttgaaattctaacttcccttgacttctgtaacacttcactctctcaatcttttttctgatcctttacaatttaaaatgttggagttcatctaagtttcatcttcggccttttttgtttctcaagctgatctacttactacccacgcactttgtgcagttccatctcctgccactgttattcactattgatactctgataactcccatatctttacaactgcaatcttcctatacgtatattcccagtgcctcctgagcttctctacctggatctaaagcccccacattctaaagccccctcaaaaatcaatatagtaaaacttattctctgtccaatctcaatctcctcctcccactcccaactccagacagtggagaaaacctgctccttctctagaatttcctatttcaccatcaactaggtaccacaagttacggtcatcaaggttcttccctctacttgtgtttttcagattttttcatagttttttttttttaagaatgtttgacacattccattaaaaaaatggcccatcataaaagacttcaaaaggtaagtagaactgcttgcttcatgtattaagtatttccacaactaaaagtttgaaacttttgtaccatattgttatctctggaagagatgggattaagctctattacttcatacctcatatatttctttactgtttgaattttttgtaatgagcatatattaattgtatagtaaaaatgaactattaaaaacctaacagtgtttaaaacatatggaggcaatgacttagcttctgcaaactgtcaaccttagacaactatgagagaaacgggacttgatggaactctcttctcagtaaacaccaagttttcgtcccaattttgtggcagagaagttgaaataaagttaaacctctaaatacaaaaaggtttattacagcagtgaagagtaatattaaaggggcctggtacggtggctcatgcctgtaattccagaaactggggggggctgaggtgggaggatcacttgagcccaggaggtcaagatcagcctgggcaacatagtgaaatccggtctctacaaaaattaaaagaaattaactgggtgtggtggtgtacatcagtagtccccacctactcaggaggctggattggaggatcgcttgaacccatgagtttgaggctgcagtgagctgatcacaccactgtactccagcctaggtaacagagactgtctctaaagaaagaaaaggaaaaaaagaaaaaaactgataaatgttaacagttttggagagtcaacagttccagaatttacattgcaccactaagctacaaaataatttccctaagtataagatgtttaaataggttatatttatgcccagtcttataaccacttgagcaaaatcccatatatcttgtagcataaggtaccttgaaattcagtcattctgggaaaatccaaggctactatagtatatgagtagtaaaaattctcaacctacttggctcaagcaacattttccacaccagtcctatgaagtgtttcctcaccagtcctatcaagtatttttttttttttagtcaccactatgctaacgagaaaataactcttaaactaaaagtggagacacctgaactactcagcaaataaatgccccaccatagagtcctttagagctttttattcttctgtttaagggtattttgctttcaattatcatcaatgagtttcacgcatataaacagaaaaagtgaaggtaacactctagtctccaggtgacctttgacaaataatcagtaatcaatgtttcttgaactgaagataattttattaaacaccaagagaatataagcagcaatcgaaacattcttaaactgaagttaaaaggcctcagtggccaggcgtggtggctcacgtctgtaatcccagcactttgggaggccgacatgggcagactgcttgagtccaggagttcaagaccagcctgggcaacatggcgaaatcccgtctctacaaaaaatacaaaaagtagccaggtgtggtggcatgcacctgtagtcccagctactgcagggaggggaggagaggtaggaggatcgcttgagcctagcaggttgaggctgcagtaagcctagatcacgccactgcactccagtctgggtgacagagtgagaccctgtctcaaaaaaaaaataaaataaaaggcctcagtgtaataaattgttaatgtgtatcttcttgagctcctgtaagaaaagggtctttgtttagttcactgctatatcccccagcccctcacagtggcacatgctaagagctcaataaatgtactgaatcgattaatgaaagaaattccatttaaaaatcaaaaataaaggcacagtcatagagttaaaaaggaatgagtcattaaatccaacttcccaccccaaatagaatttcctcctttcaacattttgccatttcaaccacttctagggacaaggagtttatgaaatttttagacagtctattccaatgatggaacaatcccaaaccccttgcctctatttctccctccacttcatgccacgtttaaggtagtaatctccaaaactggatgcatatatcctaaagtattatcagatgattcataaggatgtgagaggaaaatgagacattctatattaaattttccaaatttagattgaaaagttgtacttatatttaatatacaaatgggcactggcaccttccttcaagccacatatcaaactggtacaaagagaaaactagtagttccacaacagagaaggattaagagtggtgccctcagttggatgttccttccacttctgcacactgaaacatttccacatacattctatagaataaaaccagacctttaaacagtagaatctttgtaaagagaaagtgaatggcaattaccttctggtttcctggtttctcctatggccaagtgtttaagggttggatttaaagataagcattttccttttacacagagaagaattctccactgactatttatgtatttatgacaatgactatcagtagtacatgctacctagcagatattttccaaaaaacaaaacatacttaatctgtcttttcaaaataaagatagcactttaataatgagtaagaaagcaaccacttttcaaagactacttgtactatgaggagaacatttgaaaaactgtatttggaaatgtttccattgttccatgattttgttgctgaaaacaatgtctattaaaaacattgcttattttttaagtcattatctatatagtttacaaaatgtttaaaaacatgaaaagactattccaaccaatctaagtcttctgaacaaagagcttgaaaaactgaattttaaacctaattgtgtgtatatatgcaatgtcaattagccataatagaaaaactaattgagatcaggaatgaaaggaatgtcattgctgagttcaacaaaattctttgcataattgatcatttagaattgaaacagtaggagtacagcaattcttcaattagcatcagtttttccattaggatctgtgaatctccgaaggtacctttttttcagtcatgtaagtcattaaaatcaagtatctggctgggtcctatggctcatgcctgtaatctgagcacttgggaggcagaagtgggaggaccacttgaaaccaggagttcaagaccagctttggcaacaaagcaagagaatgaatcctctaccaaaaaaaaaaaaaaaaaaaaatcaagtgtgaaaataaactgaatttggaatcagaactctgaacagctgtatctaagggtcacactaagatttatcctaaccatcaacacagcacatgaaaataaatcagcaacagcaaatgtttactggatgctttgacattatcattttagtttacaaaacccgcccatcaagaacaaaacatcatcctcagattaagtttagtaataaatcattttgccaatgattctgaactcaaactataaaattcaaatatcactacctctgatttcccataaggactaaataaaacctcacaaatgaaagtgcctagtacaatgcctgacataaatacatactcaataaacattaactgcctttcttttgatcttaggccatgtgatgtaatacttgctagatgtgtgatggggcaaactgcttaactccatctgtaaaatggaaatattaatgcccaccttatagggttaaagtcattaaaggataatgcatacaaagcccttccacccacaaaaggcattaataaatcctgaaccctcttttttcaagataacctattcataactgtatcaaaagtatagaatcatgggttgttgaattcaaaaatatccttcagaatccctatcttttggaagaattacaggaatacaataccataagacggacgacacagagatgaagtgtgtgctccattagtgtttactgaactcaggtgaattgctaagtccattatcactcggctaattgtggcggtctggagagtctctccaggggtaggactctcacctcctggtgagcgactgggtcttactgctctcaaaccagggctctttccactatcttgtgtcctctccctagtttatgtcaggtacatactgataaaattatatactgatttatagtctctagcacaaattcgcttaagggtcataataaggtatttccataatttaagattttctgtggctaaggaagtaagggttgggcaaagggtagaagtcactctattcctgtcaaacccaaaagtgaatatactttaagtaaaatgctatgcattgaacacacaaatgcaggtacgactgcatgtggtgagtcgaaattcagatgaagcacctgtatagcaatgagtgaattcacagcctctagatgacaagtagaaggcaggttttaaaatgtctgaaaattgcaacttcagcgcttttgcaacacctgcttttacgatctgtcacgtggagcaaagaggcataactcaacagcactactagggccagacgaccattcacaggctggatacacaaacctatcttgtaaacatataatcaagcaaaagcaggcaaaccggcacaagaggccttcacctaactttcttccagatggcaaacgctgcacgatgacaaacaaggcaaacatggtgcgcaagcagccaacccaaaacaaataactagggattctgacatccaaaggtcctcttcatccttaatccttccagaatgtcatcccacaaggcagggtttgtttgccacaaaaccctgcggcccctcacatcccgagggacagttctggtcacctcctcccacggacctattgagcctgcttcacagacccccgaagcactgactcaattattcccacagtgtagattccattacatctgttaaagtttccggaacacgtgatttaggagagcaaacttgttagaaacagattaaacaacactctaacacatttctctgagccgtgtcacactcgggtccaaacaattcccaaggagggactgactgtcaccaatcttggatggcactggttcaaagcgccctaaagaggggagcgagccccgcccggctcgccgccggcagctcttacccatttgtccaaggggacctgggcgagggacccggtgccttggtacaggtccaggctgagctgctccaggctcagcttctcctgcagaaagtggcccaggtacctctgcaggaggtaccggcaggccctcttcttgatggactccgaaaacggccaaggcatagtgactgctggcagctgggctgactgcggctgcgggttgcgacggctccggcctcggggtagcgactccggctccaggccgcggcggggcctaagcctggggcggcccctccatccctatttggtgccgggagtccctcagggagaccccatcgccggcgccgcaccgctcgcgctgggcctggcggaggcaagacgcagaggggtcctcctggccccaggccaggggacttccgaggagggtcccaaccggctcggagagagtgcaagagagcgcgagaggaggcggcaggggctgaggcagccaccgccactgccgccgcgcgacgaatttgttgtcatccgcgaggcgcgttcccggctgtagggacgctcctggcgcgttcacgagacccagactcccggcgcgccgccgggcgctggcggaagtgacgccacactggggccgcggaaggcgggcagaagggcgggggctggagcagttccggctccgagggggcggggcggaagaaggcggggagggagggggcggcaccgccggtcggctccagtcgcctccggaggaaggaagaagaggacgccgggcgcgcaggtgagcggcagccggggtggctgcgggcgaggggcggcccccgagaagggctaggggctcggggcgccggcgggccgtcaggccttccggatggggacgcgacgccatgcagctggctgggccgagaggggcggcaggctgcaggggccccgcgcccgtgttaagaggggtctgggggccggtctggccggcctggctctcccggctcccctcagacctcggcgccccggaaacgcacacttggggctccgccgtctccgctgggaggactggagcccttctcgagcatccccgcccgcacccgagcattgaccggtgcccattgtcagcaagttcttcggcccccgcctcattcaggtattgtttctgaggcagcttcttcgttgccgtttgcctggcggtttgcagagcgcttctcgcatacgctcgcttaatcctgggtgtgtcatagcaacgatcaggaaacttgggttttcgaagcatctgtgggcaaaactgcattccttgagaaatgctaaaggctcctgaccccgccggaacctgggtgaagaacttgggctgttctggcagtctgcgcaatcgtatttctgccttttgggaggtaactcctgcagaggcggagccggctgttaagttaagtcaacctcgaaaggcctgggtgcgggtgttctatggcccagaagccagatgtccttcgttagaatcccggcactgacacctattagccgcccagccactttgagcggccactgccctccccgagcccacgttgcctcctttgccgagtgtgagcggattaaaatcttatgtgcatggatttgttgggaagattaaatgatatgagtagggcacgaacctgaacagagtcctgaaacatacagctgtttaatcacagtgaattaagacgaccagtttaaggagtgaaatgtttactgtctcggcaactttcatgaatgccttggaaatacagcccaaaatattggtagatggagaaacatctggttcccctttccacaaccaccttttcgttttagaaccagggtactttgtatgcagttgcttggattgttgatttccctcattctttgtagactcatctcaagtattctcagtaacttagattcccttgctcttcattcagaaatatttgttaaggtccattaaatgaaagtcaccacagttgatcatgtgaacagtgtcaagaatcaggccgaaccttcaaggagtttatgttctaaaacggaagcatggtggtacctgcttgtggaggctgaggcggaaggatcgcttgagcccaggactttgaggctgcataattgcattgacgctatccatagagtgcctgcaatttcaaatatcagaaaggatcgtacgagctatgatcatgccactgcactccagcctgaaccacagagcaagaccctttctctcaataaagtggaagtttgttcatttattcagtaaatatttattgattgccttctgtgtgccaagcactgttctaggtactgggattacagcagtgaacagataaatctcttccttcctggaacttacattttattgaagggaggagacatacaataaatgagtgaataatatgctttgtggtgataagggctgttggaaaaacgaaagcaatgtaaagggagtggagatggggaagagagaagggacttgccatttttatatgagatggtaagagaaattctcttgtttaataagattacattttagcagaaacttggagaaagctgggaagtgaggcacatgtatacctggaagagttgttttccatgcaaggggaacagcaagtgcaacgccctgtcacgggagaatgcttgatgaatttagggaacatcaagagtgagtgaaggaaaaagtagaagctgggcagtttgggggtggggggtggggcgggcggggcgcagaggaagcacatcatgtagggcctcgtaggccattgataagaactttggagccgggcacagtggctcactcctgtaatcccagaacttttgggaggccgaggtgggcggatcacttgaggtcaggagttcaagactagcatggccaacatggtgaaaccctgtctttaccaaaaatatataaaaaatcagtcaggtgtgatggcgtgcacctgtaatcccagctacttgggaggctgaggcaggagaattgcttgaacccgagaggcggaggttgcagtgagccgagattgtgccactgcactccagcctgggcaacagagtgagactctatcttaaaaaaataaaaagaactttggcctttactctgggtgaggtggatttaggagaggagtgacacagtatggcctaagtttctatgggatcatgctaactgctgttaagaatagtctggtgtggaagtgggagggccagagtgaaaacagcagaaccagttagaaggatatcaccgtaatgcaaggaaaagatgacagtggtttggaccaaagcggtagcggtgaaaatgattagttagaagcagttggattctggatatattttgaagataagacatgtttgtaaataataattctaatatttgccataaaaggaatacaaacaaggtggtatgaaaaggcaaaggtgggatcttgcaagaaattagaataggctttggaaggtttgaaatagacttctgacaaatagatacaatttggacttctttcagcagttattaaataagtggtttcctttttcaatatagaattgcattcgggctatccatagagtgcctgcaatttcaaatatcagaaaggaaaattaaaacgacggttttgcaataacaaatatgctctattcagagtattgtgtgttgccttgtaaactttatgctttctaggagaaattcagtataaatgttaaggtttaggacctgtcattatgatatctttggctacagtagggtacaaactcatctcaaatcacagtgccatttttgtgttttgtcaaagacaaagtacctgtcacaaaatgttaacaccttgcattaattaaggaagatgaaaataattaccctggccaggtgtggtgacgtgcccctgtaatcccagcactttggaaggccaaggccggaaggatcacctgagaccaggagtttgaaaccagccttggtgccagagcaagaccctatttcaaaaaataataataaattttaaaaaagaaaataattacccaaccgaatattgtcagcttattaagaattatgtaaaagtttgaagtgacaggtgagaggctgtatgccagaggctaaatgggtcatgtcaaaataatcctccttcagagaaatctgttaacatgggaaatgaaagaaaagccaaggagatgtatttgaccttttttaatgacttgcacctgaggtaacaggacgacgctgtcagggctccacacctcacggctcttggaggaattgtacaacacagcagcagccaatcccccacataatgtaaagagcacctaacttggagccacatggcttgagcttcagggtcaggctttcttcttgaaagatagtgttaaatacttttaatataatagattatattttttcagctgtttgcccagcacagttctaagcactttccatgtattcattcatttagttctctcaatatcacttaaaggtagatgctattttaacatcattttaaagaggaggaatgtgtgactgagaaagattaaaacatctttttccaagtcccagagtaaattaagtggccaagctaaaattctagccccagtcagtctgcttgagagcctgttaaccatcacatcttcctggccccttgttcatattgagaggatttaccaggttgtagtgtgtgatacaaataaaggtaatcatgattaagatatcgtatcctgccctcagctgactgttaacaatgtcaactgaaaggtcagactttcaaagtgaaaatttgcactccatatgttcttgaaatctttctggggctgttcttttgtcagactaagtatatatgactgtctttgcccatttttttgtcatcaaggataaagctctttgatgctctgaactcgtaatgaaacaaaatagtctaataaattaggaagtaaagaataaacgatttagtaatcaatgtcataataaccagttggatgaatcctccaaaaacacaaacacccgaacaccgcccaaaaattatggagaaagagctggttcctaaataatttatgtatgatgttttaaggaatcatttatggaaactttacatcaggtgatacaacctaccagaataaataatagcaattgtcaagtattccaatttttgtctctttgctagaaacagaatattgctcaggatctggtagagaaccaatttggagtttaaatggaaagcagtgaggttttctattttatgtctctgtagatattgatttatgtttgttagaatgtactttaaatatagtgccaagtaatacttatttcctagaggattatatagaaataagaaactgtaataactggaatttttttttttttttacattccatttttgagtgtcttttcctagagtctcatttacagtttctggtttcgaaggaaaggtttacaaggttgtattgctactcttttttttttttttttgagacagagtctcactttgtcactcagactggagtgcagtggcacgatagctcattgtagcctcaacctcccaggttcaaccgatcctcctacctcagcccctaagtagctgggactacaggcttgtgccactaatttttgtatttttttgtagagacagggtttcaccatgttgcccatgctggtctcgaactcctggactcaagcaatccacccaccttggcctcccaaagtgctgggattacaggcatgagccacagcacccagccagtgttgctgcttatttacagtttgtaaaaactcaaattaaccctgtgtatttctttcttctgagttccctccttaatcaacaaaagcactgctgtggtttggatatggtttggccccaccaagcctcatgttgaaatttgatccctggtgttagaggtgaatcctggtgggaggtgtttggatcatgggggtggatccctcatgaatggctttctctctgtatctctctgtatatctgtctccctccctctcccctactccctctttctctctcacttcccctccctccctccttccttccttcaccatgtgatctgcatatcccagctccccttctgtcatgagtggaaacatctaaggcagaaaattggtactgagagtggggtgttgatataaagagacttgaaaatgcggaagcagctttagaactgggtaatgggcagaggttgaaagagcttgaagggctcagaaaacaggaagatgaaagaatgtttggaacttcttagagattggttaaatggttgtgaccaaaatgctgatagaaatatagacagtaaaggctatgctgaggagagctcagatggaaatgaggatcttattgggaattggagcaaacatcacccttgttacactgtagcgaagaacttggctgcattgcctccataccctagggctttgtggaaggcccaacttgagtgatgacctagagtatctggtagaagaaatgtctaagcagcaaagggttcaagaagtggcgtggctgcttttaacagcttacaattaaatatgggaggaaaggaatgacctaaagttggaatttaaaaggaaagcagagcataaaaatatgggaaaatatgcagcctggccttgtgttaaagaaggaaagagcattttcaggagaagaatccagttagttcagataaaagggagccaggtgctaatagccaagacaatggggaaaaggccctcaaggtatttcagaaatctcctaggctgtccctctcatcacaagtctagaagacaagaatggtttccacagtcaaagccatgggcgcaactgtcctgtgccaccttggaatgctgctccctgcatcctggttgctccagctccagttctgtttcaaagggctccaggtactcagctcaggctgtaagctgtatgtctttgcagcttctatgtgttgttaggactttggggcacagaatgcaaaagtggcagaggcttggcagcttccacctagattttagattttagattttagattttagaggatgtatcagaaggcctaggtgtcacagaaagactctgctaggacattgccaagcagaaatgtggtgttggagccccgatggagagtctccactggggtattgcctagtagaacagggatgccatggggaccacagaattgcacagccactggcagtgtgcaccctcatcctggaaaagcctcaggcatttgactccaactcatgagagcagccacatgagctgtacccagcagagtcatagggatgagactgcccaaagccttgggagcccacccctcatactgctgtgccaggatgcaggacatgctaaaaggagattttggaacttgaaggtttaatgtctgccctgatgggctttagattctcatggagtatcttacccttttctcttggccaatttctccctttggaaaacagcatttatccaatgacttttccgtcattgtgtatcttggaagtaaataacttggttttttacttcacaagcttatagctgcaaggaacttgccttgagtctcataagaatttggacttttgagttggtgctagaacaagttaagacttggggactattgggatagaatggttgtattttgaatgtgagaaggacactagatttgagaagcgaggagtggaaggctatggtttggatatggttcgtttggccccatcaagtctcttgtcaaaatatgatccccactattggagatgggacgtggtgagagctgtttgggtcagggagttggggcggggtagggttggggggccagtttgaggtgggagaggtgtggatctctcatgaatggcccggtgtctttctcccaggaatgagtgagttttcactctcagtttctgacagaactggttgttgaaaagagcctggatctcctgctttctatctacctacctacctatctgtctatctcccccacctccaccctttctgactgtgtgatcttcacacactggctccccttccaccacgagcggaagcagctggaggccattgcaaatgccggcactgtgctttgtgtacagcctgtggaacgatgagccaaataaacctcttttctttagaaattacccagcctcacatatttctttacagcaatacatagagactaagataagcacaattctgttgtctagatttataattacaagaatataaatatgtctgtgttattgctgaaaatggggtgcagaataattttataaaccagagtataaatgggaaaatagccattcttacttgaattacaaatactttatatttgtgatactacacatgattctgaattaaaatgttttatttcaaaacaaatacatctgtaagctattgaaaacagattaaatgttatgtgttacagaaaacaaaggttaaattgagttttagctttgcctaaattctaaatcttgctgataataattaataaactttattcatctttactttcaaaacagttgttggaaatgcagataaattcagaactcttgttttatttgtaactgatgctaccagttattttaagtgtctgaataataacctgacttctctaagaaaaagatttctgcttcctacaccctatactttccaaaagactgcaatttttaaattgttttttcttattgaaaacataatcattttcttttcaccataggaaaattagaatattaaaaaattaaagctatcaacaatcttttttttttttttttttttgagacagagtctcactctgtcacccaggctggagtacactggtgcaatctcagctcactgcagcctctgcctctcgggttcaagagattctcccgcctcagcctccccagtagctgggattataggcacgtgccaccacacctggctaatttttttctatttttagtagagatggggtttcgccatgttggccagactggtcacaaactcctgaccttgagtgatccacctgcctcagcctcccaaagtgttgggattacaggtgtgggccaccacacccagccaaaactatcaacaattaatttttaacaaagagcaatagcataactgaagtggaaagagttgcaaaaacttagagaaggcctaactcagccctaaccttgtatccttttaccagctcctgcctctgcttgttaactttatactgccagacacggtgcctgaaattttcatcttgttgaattaagtccttgggttagggctatacttctaaaacgtatttttcatgccaatattcctcactcgaatgtaccttttagaggcaaaggaaaccctagacgcgtaggggtataatctaaagaggatgtggcttgagacatccaaacatttgtgtactttttcattaaaattctaggcagttctgtaatatttcctgatattgatatagtaacagtgatatgtattttccaagaatatctgccatgtttgtcctgagtctttgtatactccttgtcacagagccgagtatcacacctgagaagcagagagttagaattttctctgttttattcattcaggaaatattcaatgaagtcctgctttatgccagacactgtgctggtgatgtgtatatcacaggctcccatcttcatgggtctgtagtagtacagacacaaaaattatttgccatgaggcttaagtacagcagtaccaaagcagagatgctgttcaggaagatacagtgattggccatcttgagagcagatacacaatcctgaaataggtttgtctgagctgaattttagaggactaaaagtcttcaaagtcgtgttaaaataaaattttttaagttaaaaacatggatctcataaaacatatggtgagcatgtgtcaaaatgcatttaattcattaatgaaacaaacaacaagatggtaaaagttggttcagagtagtataggtgatccctgagaagcatcatacaaatatggtgagcctgttgccctattgtattgcctagagccaggcatggcactggaaagaaaaatccaggtaaagcctgatggtctccctgaattgaggacatagagctggaaacccaagaaggccaaggcagctaggacagagtactagaaagtaaatagcttcacagaaagcaaggactgtgaggatataggaagggtctccctccagcctgtagctgaatactaattcatgagttcactgccctaggctggggaaagaactaccaaaaagaatgagaggaggggccaggtgctgtggctcacgcctgtaatcccaacacttgggaggctgaggtgggtggatcacttgaggtcaagagtttgagaccagcctaaccaacatgatgaaaccccgtctatactaaaaatacaaagattagccaggcacggtggtggccacttgtaatcccagctactcaggaggctgaggcaggagaatggcatgaacccagaaggcccggattgcagtgaactgagatagcaccactatactccagcctgggtgacagagcgagactctgtctcaaaaaaaaaaaaaaaaaaaaaaagaaaggaggatactcagtttgggactttctgaagcagaggtgatatgaaaattatacatctcctcatttctttggagactaagttgctggatcttcatctttattggataatatcaaatcattttccaaagtgttgtgccagtttacactcccactcagtgtctaaatgttctgtgttctgcatcctcaataatacttgatttagaaaattttttatgcatagactcaaaaaggaaaatgtcttactgatctgcaagatgttaaatgttacctcattttaattatttctataatttctaactgtgagtgtattttcatgtgtttaataatcatttctgttcttccattaaaaaaaaaaaagaattacaggaaacagttttctgagctaaagcaggactagggataattcccattcttatcacacagaatagaaaccctcgtaattcatagggcattgggtagagtactcagaaaggttttgcctctgtaatgggacagaattaactagagattaaacgcagatcttgtctaaaagcaagacccagaaagatcaagctgtttccagataactacctcccaggacaatgctcaacaatatttattactttttaaattttttctcaccatgcgtctaaccaaatgaattcaataatatttaaaataatataaaaacattcagcaccacattcacaatgtctggcatccagtcagaaaagaccaggcatgcagagcagcagaatataacctacaattgagaagaaaaatctgtccgttgagagtaacccagaaataatacttgaaattagtaggcaggacattataacacttattatggctgtattttatatgttcaaaaagctagaaaaaagattgagcaaattaagcaaagacatggaaaatatgtttaaaagattaaaagacacaaatagaatagatactgaagaaaagactaacaaacttgaagacatatcaataaacaattcaaaatgaaacagtgaaaaaaataaatacagcaatgaggaacaggacaccttcacttggactaatatacataaaattagagtccccaaagaggatagggacacataaatgtttgaagaaataatggccagaaattttccaaatttgttgaaaactctaaacctacagattccagaatctcaatgaaacctaaggaaaagaagcatgaaaaaactacaccaagaggaacaaagataacaatcacatcaaatgtttcatgggaaacaagacaagcaaggtgtgatagtcgagaaacatctttttaatttttttattttagagacacaggctcttactattttgcccaggctggtcatgaactgagctcaagcagttcttccaccttagactcccaaatagccgggactgcaggtgtatgctactgcatccaagaaacatatttaaagacttgaaagaaaaaaaaactgccaacctaggattctctacccagcaaaaacatctttcacaaatgaagatgaaaaggagactagttcagacataggaaagttgaaaggattcatcaacagcagacctacactacaggaaatgttgaaagaagttattcaggcagaaggaaaatgatacagataatacatgtagatatagatcagtacaaatgaaggagcacaaaaaatggtaattatatattacatataaaaagacttatctaatctctctgaaaaataattgactctttaaagcaagaataataacattatgatgaagtttataatttatgtagaagtaaaatatgtgacaaaaatagcaaatgctatatagtagtgttttgtaaagttcatatacatgaagtagtatagtattaattggaggtacattgtgataaagatgtatactataagctttaaagcaaccaccaaaaacacaacaaaaaatatcgttaataagaaccaaaagatataaaatagaatcctaaaaagtggttaattcaaaagcaaggaggaaaataaggaaaagggagtaaagtacagatgggactaaaagcaaagaaatagcaagacagcaaattcacactcaactatatcaataattacagtaatcaaatgtaagtggtctgaacacccttagtccattttcagttgcttataacagaatacctgaaactcgaaaatttataaagaaaagaaatttatttctttttctctctttttttttttttttgagacagcgtctcactctgttgccccggctagagtacagtggcgcaatctcggctcactgcaacctccgcctcccaggttcaagcgattctcctgcctcagcctcccgagtagctgggactacaggcatgcaccaccacgcctggctaatttttgtatttatagtagagatggggtttcaccatattggccaggctggtctcgaactcctgacctcgtgatccacccacctcattctcccaaagtgctgggataacaggcgtgagccaccacgcccggcttgaaatttatttcttatagtaatggaggctgagaagtccaaggtagaggggtcacatttggagagggccttcttggcggtggggactctgcagagtcctgaggtggcacagggtatcacatggtgagggggctgaatgtgctggctcacatctttccccctcttcttacagagccaccagttccacttgcatgataacccattaaactattaatccataaatggattaatccactctttgggtagagcactcatgacccagtcacctcttaaggcttcactttttggtgctgccacgttgcattggaaattgaatttcaacatgagttttggaggggacaagtattcatactaatagcacaccccaattaaaagaggttgccagatggatgaaaaagcaggaccacactacatactgccagtaagaaacccatattaaataaaaagatatttgtatttccattccgaagaccttaaaacagcctattatatcaaaatcaaattcctctctctaggtgtcagcatgctgtcagattgggccatccctgcatatccttgtattttagcccgactagttcctgccacaccctgtgctgacctttgcttatgctttgttccctacacagaatttttcacaactctcaagacctttttgcttatttataactctttattcatgctcattccaaaccaattttgactgacctgtacccttagtcaagccccatcataactaaccattacgtcatagattatagaatgtcaaagctcttagaacagtaaagaattttctgcctatttaccttattttgtagatgagacctccgtaagaccaatgagattatgtgcccaactcaggttcatacaagtttagtgataagagtttgtagtaggacgaagacatatcattgttttctgtaattatctgccactcacaattaagtacatttggggagaataattatgatgtgtgtgtatggcattaatatttgtgcaaatatttcatgtgcctgttttctttcccaaagtagactgcaagctaccagtagatatcttttattagtattctagtgcttaaaaaaaagtcggctatgtaggtaccgagtggattatgatatttgattaataaacttagaatccaagtagacaagattataaaacataggataatgattcattagtttttactatttgaaacaatgatgattgattcctttacatacagtaattaagattcaattatatctcaagttccaaattttgctactcatatataaagtttgattcagtgcctttacatctgctgagatttttcaaccttagtataaactctgcttattatattatctgcaagttttcacagaggtctagacctgtgccatctgatacagtggccactagctatttaaatttaaatgaaccaaaattaaataaatttttaattcaatttctccatcacagtagccaaacttcagatggctattagctgctgtattggagggcaacaataaagaacatttccgtcatcacagaaagttccattcatttagaatttcttatatgatgataaattgttttgtgtacaaaaagggaaagcaaagatttttacaggattcacattgatgagtcaaccattctggtaacctgatggcagttctaaagtgttgatagtaattctagtggttgttccttcgctgaaatgggcgtgtattttctcatcctcaatggtacaggcttctagtcaggtacacagataatccattgagcagaaaatatatctatattccatctttaccttctgtttaaatgtatatttatatgtcttaaatattttaattgtggtagaatatttatataagtgcttataataaggtgtctgctcaaaatatttttaccttctggggtacataatccaaagtgtggaagctgcttctcaagtgtcggtcaacatagcaacctagctgctcactgctctgcctctgtaactcctgtcatcaccagctaactgacttcatggtttttggctcttttcaaactccttgagagagcatctgattagctagaccaccatccggaagtagttggacaaagctcttgacttgggacataaataaaccccttgccaaccttgagatggtgcctttaattggaatacccatccccagtacatgttgctatgatgatgctggaattaaaatacaaagcatgaaacctatgattcagaaacctttccagagaaggcaatgggcttggcaagtactctaggcttccttttaagagaagcatgtaaactgcttagcaccttatgttgcccatcaaatgtgttcactgaaaataaattatggccaagcgcagtggctcacacctgtaatcccagcattgtgggagaccaaggcaggaggattgctggatcccaggagttcaagactagcctgggtaaacataggaagaccctgtctctccaaaaaatagaatcacccggacctgatggcacccacctgcagtcccaactacttgggaggttgaggtgggaggatcatttgagcctgagattgtgccactgcactatggcctaggtgacagcaagatcctgcctcataaataaataactctccaaaaaaaaaggaagagcagaaaaagaagtcatttgaatgtttttattatgttaaagattgaggaaggtaccataagctaaggaattcagatggcctctagaagtgagaaaaggtaaggaaacagattccttcctgaagcctctagaaggaatacagacctgctgacatcttgcttttagacttctcatctccagaactgtaagagaataagtgtgtgctatttgaagccactaatttggtaatttattatagtagcaataggacactaattgatatccaaagattttggatatttatctataaagcttttattaagcactttctacatggcaggcacaaaaatattcatcatgatcacccgagctccattttctaaacctttttaccttcatagggctgttatagagctaaatcaatcactgcctttcattatgggtagactcctaaatccaatagaatgctttctgttgcccgtaagataataggaatttgttggctccgataactgaaaagtgcaaatcctgggaaaccagcatgggctctggccacatttctctgtgaatctcttggctctgtttttttctgttgtcagcatcatgcttgggctagtggccccatctcaacatggctacttggaacagcttgagctgtgtgctgtgactgaactaatctgattaaagtgaccaagaagtccgggcgcagtggttcatgcctgtaatcccagcactttgggaggctgaggcgggtggattgcttgaggtcgggagttcaagacaagcctggccaacatggtgaaaccttgtcttgactaaaaatacaaaaattagccgggtctgtaatcccagctactcgggaggctgaggcgggagaatcacttgaagccgggaggcagaggttgcagtgagccgagatcatgtcactgcactccagcctgggcaacagagcgagactctgtctcaaaaaagtaaagtgaccaggaagaatttcatgtattaattagtttgaagagtctgtatctggggattggagtcaatctcagccaaattgcttggttactttacttagtacgggaagggagcattatggttgcccttggaaaatatgggtggtcataggcagggaaaaggatattggtaaataatcaagaacctgcttcaaccaacaaaaaacaagttgtaatcataccttaaaataatagctaaaaatgttatttatgtaatgctccattactttaatttatatgtatcatcaaaagttctaaattgtatgttattcaaagacatttcagggaaagtgtcttaaaagttcagtcttaggaaaggtgtcttcctcttttttgcagctcggtgctgattatcacaactgtttggtgacctacttcactgacctgtgaggattccttcccttcaggtactggattcttgatctttctgcatcatcaaggtcctaattgcaatgaattacactcttgcttaaaaaaaagctttataaatgtaaaactttctcatataaacatctttttatgtaatgatcattatttctgacatctccaattgaagtacttgataacttaagcaaaattaagatgtttgatattcatgatgtcaagagatttatagtagtcatttctaaatcttcaaaactatgtaaaaaagaaagggctcattttgtatgtataagaccaaatataatcttgagcagtatactgattatttttggaataaggtaaaatttggaaagccaaattttttttcctatataataagtcaatttgagctttcagttacccaacagattgctccagcaataattggtaattttataattaacttctgttgtttgtagcgagtgactaattctgtaaagtgctgtgagagacgagataaagagtctttaaaacattattaattgaaataggattggaggaatacattatacatttgctatgtaagtttttgaaatagctttacatatgttattataaattgcattcagcaagtagttctgacttttgtaatgtgcaaatgacattcagctgtaggaactccagcttcttaagatttttgctgataatttagagcagtggctgcacagcaaaatcactcaggagctctgaaaaaaataactcgtcttccagagattttgattttgtttttctgcagtgaggaaaatgtatctgtaattttataagctcttacaggtaattctaatgactagcttaaaggattttgaatgtcactatcttgaaggattttgaatattacacaaatagggcataacttggaaatagcaatggactgtgcagtgtaccagatcggtgtccatattgtcagaaaaaaattgagactccttctaaaaatgcatttaagagccaggtgtggtggcttgagcctgtagtctcaactactcaggcggctgaggtagtaggatggcttgagctcaggagttctaggctatagtgcacagtgatcacacctgtgaataaccactgcacgccagcctgggcaacatggtgagaccttgtctcttaaaatacaatgagtttcttaccagtctaatctaactccagtgtggtgagggggtgggactagaccttgaccacagtgcccaagtagataggaaatgaatgttgattgaatatgtgagtgagtgaagagttatgcttcattcacgacagcagatgcttaatccatatcagagaagtgaaactttacttttaaaacctgccaagcaaaaagaaagcacaatagctcaccataacttgttctgtaaagccttttgtacattccaaagcactttcacattaacttttctcattcatacatttcaaattttaacaatacatatagccaggaagatcttttttaaccccagttacagaagaaaagctaaaaccacatagcagcctggcagtaatatttgatcaagttagcgtgagaaattagaaataatatttttcaaaatataacatttgggtcagttcaaattaatggtgaaaagatgagttattcagtaaatggtattggtacagttggctatccatttggaaaataaagttatgcaaaataaattccagatggatgagttaaattcagatacaacgagaatttaggggatttttaaaatgtaatcatggtatggggaaggcctagagcagaaccccaatccagaagtcataaaaggagctactgagacttacctactgtggtaggtaaagacttgcactctgatttcatgcaatttagatttatttccatttctgcttattgcaactgtatgatcttagaactaaaactatcctttaaacatccaaacagatgtttactcaaggaaatacatattacaacaatgagctatcattctttgcctcttaaattggcaaaaatttaaaagaattggaaagaggtgaaaaagagtacagtccctcatattctattggtaaagtataagtcatactctctttttttgtttttttgaagggtaaattgacagtatctattaaaagttaaaataagtatgtcctttgactcagcaatttcagtcctaaatatctgtcctagagaaataattatacatttaaaaatatgtactaggattgttactgaggcattattcaaaatagctaaaaaacacaatattctaaatgcttatcaatatggaaattgacctgttgggggtaagtggagaagggagattcttttttttgaagatctatgggtgtcggtgattttgctgtgaaaaaccactagaaatgtttttagatagtatttttcctaacaattgttagctagtgttttgtactaaggagcaattgtaaggcatagctaattttaatcaaatgtagtagtttgaatgtctttctataaacaaattttataactgcttttttttttttttacagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtaactcacttttccttttagaaaaaaaaattatttatgtctttaccactttatcaaaaagaggggtagtggggaggggaagagtgttaaaagagaactggatattcagtagcttccaaatttttttaagaaaaacttttaacctagaaatttttattaattttaaaggcttttgatcgatatggggaaacagaatttttttgaaaaacatttgatttgcagggcgtgactttgttttaatcatgacccccaaaactaatttatttctcatctatagctaaatgtgttcaccagaattatacatacattctttgcattgaatgggttttgcagtcactgtgttgaaaagattttcaacacctcttgaaaatgtcgcttctgttaaaataacatacttgacaacactgttttccaactctgagatcagaaataaatcagagcagaacattccacccccagatttccaagagtgtcccattaaccctttattatgagtatctctttattatgagagcttttctaggcggattaacctttccattctttaaaccaaaatcatgagtttagaatagtagaaaacatcacctgagagcaacttttaattaaaaaagaaaaaactataggccagacctgcgggctcttacctgtaatcccagcacttagggaggccaagctggtaggatcattttagagcagaagttcaagaccagcctgggcagcatagcaagaccgtgtttctacaatatattttttgttaattaacccaacatggcagcacttgcctgtaatccagctacctgggaggcttaggagggggcctatgagttcgaggttgcagtgagctaggattgggccactatactccagcctgggtacacagaccctgtttaaaaaaaaaaaaaaactattataaaatctttgacctactgaacaaagggatagacattagaaaatctaaaatctagttttaaccttactaatcagtgaatcttcagtcttagaaaatgtcatacatttctgtgtttctatatttattcaaagtaattgtacattatcataaggtggtgagcaaggcctgcctaagcaagtaagaatgtcacatgatatcaagtacataaacatctctttaattcgctggattcactttgctgaagatgagtcgtgtatactgtatattccttgatggagcaaattgcaaggccagcatctgtactaccctcagttccctcacagctgctgcaaagatagctgcttagctttaagcatagtacctgaattaactaatttttgtgcacttcttttcacatccttaaatttgtactaaaagctcagagtatttagaggtgaatcttaaatcagaagtagagataaatgacagaattagtaagataattctgtcttgtgttggttaattctaagttgactgtggagaggtagaaggagttctgatcagagagtcagcagtcttaaatgtgaatttaagtgatcttgagtgagtccgtctacccctgagagagtttctgcttcttaatctataacttggagatttaaaaaaaacttaaaacgatttggggaatgattatatgactgtatgatacagaaagatctgaaccatatgtaaaacctgacatgtagtaggtgctcaaatatttgtttgtttttcagtctgattcagttaacatttattgagcaactatcctgtgtcagcaattgaaaatcaaaccatgcataagacatgatccctgtccaccaggaagatcacagtctagcagagataagaggaagaaggcaaactgaactgtactccactgtagagagtgcagtaatagagcatggatctgaagaggtgtgattcattttccttaggtgtctgcctctgcttttcatttaaaaaaaaaaaaactcagcttctatttctaacacaaactttcacctcctatggcttaaatagatgtcataaaaatttaggatttatatagggaatgtacacacttaagtcagcaaaaactaaattaattttgccctatattgtgctggtgaaccatgatataccttataatcttgtcaaaaagaaaagttgtagctgtgttcacaggaaaaaaaaaaaaagaaaaacacatggcctgtcagccttttgcctaagatcaattggagtatcttttcttatcagtttaatatctgttatgtcctctatctaaggacaatatattaaatggatttttggagcagggagatagaataggctcttgctccattaacttcacacatcgacctggtattgcaaatacctccagaaatagtgtacccctaccaagaaaaaaaaaacacattaacatgttcttttatctcacagaattgagcatttattccctgtcaggtaagaaatatattaggtgaaagtggcctttcagattactaataataaagctaaacagttattaaaactaataaactattaaaccaattattaataaacaattattaaaattaacaactaattattaaaactaaattattaggaataatttttagaattgtttataaaagaagtgaaaaataatgaaaaaaatatgaactaatgatatattacctattatagtacttaatatagtggaccctcaatatatgtggaattaaatggggtaaataatagatgcatgttttagaatatgaaaatgaaataccatttttgtgtagcttttcaaattctttctctgcatttccttgagcttctaagtaaaaccttttaaatgttgaaaattctatagggagcattttagtggtgtttctgtgttatacattataagttgctgaagtattaaaggttgtatttaaaatgtgtatactctgactttgagaaatagtttcactcagttacccatgtatctggtggtctagtggctaggaaaagaaataatttatttttttgaaaggatgattactcacataaacacttggattttgctttctgtaccaacatgaaaactaatgaattcactgttgcatttctcttgtaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaagagcttgtttccattttttaattctgcattgttacatttggatttgaaatgactgaagtgagctttctcttgttactactatgaaagagcaatgaggaacaagaggagaggacattaataaaactacacagatatacatgagaatctagatattaaaacctccattttacctggtctgtttaaagaacttaaccagcagataggccaggtgtcgtggctcacacttgcaattccagtggtttgggaggcccaggcaggaggatcacttgaggccaggagtgcaagacagcctgcgcaacatagatcccatttctacaaaaaattataaaagcatggcctggtgacacatgcctgcagtcctagctattaggaaagctgaagcatgaagattgcttgagcccaggaattggagactgcagtgagctacaatcgtgctgctgcgctccagcctggatgacagaacaagaccctgtctcttaaaaaaaaaaaaaaaaaatgaaaattataaaacttaaccagataaattaagccttgatttcacttctaaaggaaaaagaaaaaaaaaacttttatataaataacttttacaaatcagtaggaagaaaaaatgcaaacagtgggcaaataatatggtcaactcagaaaaaaaaatagatgtcagtaactacttgaaagaggcccaacccaaccattaactcaagaaagagaaattttaagttattgggtcatttcacctgctacttttgtgattcttcttatttaaacttaataccagtaaggatttaatgaggaagcactcttacattctattggagggtatattgttgaaatctttctggaaacattggtaataaatcctttacaagtttataacttctgaattggtaatatactagcaacctagcatagggaaatgattcagcaaaaaaactagtatataaggatgttcatttcccctaatgaaaaattgggaaggctctaaagagtggtaaagtgatgctacatcttttgatggaaaaatatgcaaccactaaaaatcatgaaaaaatggcaatgagaattatgctacacaaaaaaggatataaaactatacatacttttttgaaaaataattgtatatgtaacaaaaaaagattataggctgttagtagtcatcactaggtgataaaatagataattttcatttccttaatactttttcacattttatacattagcttgtatgtactaattagaagcaggaaatgcaatagatgtggggtttaagctacctagaggctgtctagcaaaagcaccaatccttgctgagttgtatctgctcccagatccttgaagagggcagaatgattatgaagagaagagtgcacacctcatttcccatgatgacactcttcccacctttcctccaggttcggctgctactaatgtacttacaatcattagcttcttctattgcacactgtgctgttctctccccggtgttcaaaaacagaatgtgctgtttgaatgttgaggaacatagtaagaaaacactgagattctgataggtgccacattgacttcagaactttctttccaatccctttattttctggatgatacaggtgagatagacagattgagcgacttgctcagcaactgcttgtgagcagtgtagttggatcagaacctaggtcttctgactccgccagctgtccccatacagtacgtgttaataaaaaccatcacattaattttgtgtttatacgaaaactgattttaaaagagggaaagaataacaaacatgttagttggtatactagaattagtagaatctctggcctgggtgtggtggctcacacctgtaatcccagcactttgggaggttgaggtgggtgggtcacctgagatcagaagtttgagaccagcctggccaacatggtgaaaccatctctactaaaaatgcaaaaattaactgggtgtggtggcacacacctgtaatcccaactcctggggaggctgaggcaggagaattgcttgaacccgggaggcagaggttgcagtgagccaagattgccccctgcactccagcctgggcgacgagtgagactcaatgtcaaaaaaaaaaaaaaatagaatccccttttttaacctaccaatatatataaaattatctagaagctatcccccctgtaactgtggcaagctcatttcatgaaagaaacaggtaagttaaatatttcattgtaccatgactggttgaataactttcaaagtgtttacctgcttaactgcatatcaacaaggaatgcagagataaactaaaaatttgaaaatgaatcgtgaattttagaatagttgaactagtaagtcatttgaaagaatgctgaagtatattttctaagttttgcactaattttgcatgaatacttttacatttaaactgacattactttcttgttgattaaagaaaagcaaaaaattgccgggcctgggggctcacacctgtaatctcaacactttgggaggccgaggcgggtggatcacaaggtcaggagttcaaaaccagcctggccaaaatggtgaaacccccattctctactcaaaatagaaaaactagccgggtgtggtggcacgcgcctgtaatcccagctactggggaggctgaggcaggagaatggcttgaacccaggaggcagaggttgcagtgagccgaggtcgcgccactgcactccagcctaaaggatagagcaagactccatctcaaaaaaataataaatttggtatgagcaaactgttcccaaattgagttggcaaaacttcaaagcgttagtttatcaaaacaagttttaatgagagttgcatgtatagaaaagaaaatggggtggggacagaaaaacgaaatataaaggctcccatctgtacaagtgtgccttagccttgcaggaaaaaaaagcaataatttcacctttggcgaccacttcagaaaatgcttcacatatgtcttatttaatcctaacagccttgttaggctggtggtatcactcctattttacagacaatttaacagcatagggaaagttaaaagattggtcccagcctcccacaaatcactggagagctgaaactcaaagccaagtctcatgagtgcctgaaagcccagagcctccaagctgtctgaagatgttgggccacctccgttttttgaaacaaccagtattttttaaaaagaagaaggccaggtggggtgcctcacacctgtaaatcacagcactttgagaggccgaggcgggtggatcacttgaggccagaagttcaagaccagcgtgaccaacatgctgaaaacctgtctctactaaaaatacaaaaattagccgggaacggtggtaggcgcctgtagtcccagctacttcgaaggctgaggcaggagaatcgcttgaacccgggaggcgaggttgcagtgagctgagattatgccattgcactccagtctgggtgacagagcgagactccatctcaaaaaaa

SEQ ID NO: 2 - DNA, 11099 bp, HOMO SAPIENS
  misc_feature: mRNA sequence of the human ATG2B gene
acagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtccatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaagttggatgttgatggacagatagactctattcatctactcctgtcaccaagacaggtgcacttgcttttggatatgttggcagctattgctggaccagaaaattctagcaaaatagggttagctaataaagataggaaaaatcgacccatgcagcaggaagacgagtatcgaattcagatggaattaaaccggtattatttgagaaaagattccctctctgtgggtgtatcttcagagcaaagcttttatgagacagaaacagctcgtacaccttctagccgtgaagaagaagtattcttctccatggctgatatggacatgtctcatagtctctcttctcttccaccccttggggaccccccaaacatggaccttgagttatcattaactagtacatatacaaataccccagcaggatctccattaagtgctactgtgcttcagcccacttggggagagttccttgatcatcataaagaacagccagtaagagggtcaacatttccatccaacctagttcacccaacacctttacagaagacatctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacacgatcaccttagatttataggtactggcattaaagtatcctatgaacaaagacaaagatcagcttcccgatattttagtactgatatgtccattgggcaaatggaatttttggagtgcctatttccaactgattttcattctgttcctcctcactatacagagcttttaacgttccattccaaagaagaaactggttcccattcccctgtgtgtcttcagcttcattataagcattctgagaatagagggccccagggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcaagaaagaggaccatggtttaagaagtcacttcagaaggagatcctttatttagccttcacagatctagaatttaagactgaatttataggaggatcaaccccagaacaaattaaattggaacttacctttagagaactaattggatcgttccaggaagagaaaggagatccatctattaagtttttccatgtgtctagtggagtagatggagatacaacatcgtcagatgactttgactggccacgaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacagatggtgatgccaggagaccctgtagaaatgacagaatttcaggataaagcaatcagcaattctcactatgtgctggaacttacgttaccaaatatttatgtaacactacctaataagagcttttatgagaagctttataataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatgatgaggaaagtggatctgaggaggagactttgcagtatttttccactgttgatcccaactatcgttctcgcaggaaaaaaaaattagactctcagaacaagaactctcagagttttctctcagttcttctgaatattaatcatggattaatagcagtgttcacagatgtgaagcaagataatggagatctgttggaaaacaagcatggtgaattctggttagagttcaatagtggttcattattttgtgtgacaaaatatgaaggttttgatgacaagcactacatttgccttcattctagcagtttcagtctgtaccataaaggcatagtgaatggagtgattctcccgacagaaacacgacttcccagctcaacccgcccacactggttggaacctactatttattcctctgaagaagatggcctcagtaaaacttcttcagatggagttggaggagacagtttgaatatgctgtctgttgccgttaaaatattgtctgataaatcagagtccaatacaaaggaatttctcattgccgtaggactgaaaggagccactctccagcatagaatgcttccttctgggcttagctggcatgagcagattttatacttcttgaatattgctgatgaacctgttttgggatataatcctccaacttcatttacaacttttcatgttcatctttggagctgtgcacttgattatagacccctttatttgccaatccgatctcttcttaccgtggaaacattcagtgtttccagtagcgttgcattggataaatcttcctctactctcagaataatcttggatgaagctgctttacatctatctgacaaatgcaatactgtcactataaatctgagtagagattatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccacaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttttacaagtgtcttttcagactttggtgttgtgatgacacagtagaaagagcgtggctagaatccgtggtttgccacatctgcagcttaccaaacggatgacttgtccaggacatctgatccctgtaagcctcagcatccctcctggtaaatggagggttttttacgacaaagcccaaagggaggttttggatgattaggctgtgtgtgcgtgtgagaatgatcacatgtggcgtcatgctttgtacagagcctcagaccactgggcctcgtccagtgagagtcctctctggcgacatcacacgcggagcagccaggggccaccttagatctcagatctctcagagcaatacttttctgaactgccactgtgcctgggtggttgggttggtgtcatgcttctgactagagtagatcgcgcatgtccaccagtgatacgttgagtccttacagttccccccatggagtcccataagcagctccatcgagatctgtcagcaagttgcaggaccccacaatgttctgacatgttaagacccccttacatgacgagtagagaggcagctgaggccacaaccgtgtcttcctcttgaatggagctaactcggaaccccccgttttctcttcctttctgcccaccactgaacattgccttttagataactcagtgtttcttctagatgtcatagcaatagactttcactttcatgaagtttgggtacgatttggattctcgcttaagtacatatatttatcaatatttttataaggcaaagttcacttaaaaaatctttccaagtagcagtgtgcctaagatggcaaaatactaaaaactggtgtttcctgctcctgttgtgtgtcacttttcaagccgattgaaatatttctggcttttagggcattactttttaactatctcctttaaaaacgatgttctgtaggtttagtgtctttgttcatttccaaaagagtccagacaactgtgtctgcccctgcagaggctgtttgtccaaaggcagcatgccgcttccaccggaatgcagacagcaggggagcggaattctaaagcagcgacttaaaatgaggaatccccaattgcactaaatggtttcaggattgactaatcattgtcttaacattaactcagattttcaatgtgtaaagagctgtgtgacttggcgtctgagagatccctctgctttgctttgcttcagagtcctcgcacccgcatcctcagaactgtggggcatggtgggctctaacgagcactccccttctgttttccttcattacttttgacctccttaagacttcagagagaatgtccgtcaagttcttttctccatcaagttctttaagttccttgaaaggaagggactgtgcaaacacaaagcaatattcttttgtatctgcaaatgcatcagctggacataccaattggtatcaaatagaataaaatcaaatataaatgtttgagtcttaggttaaaaaggaaggttatttgtatagtttatagataatgaaggaaaaatttctttttcattgcaggaaatcttgtttactggaagatagagtcactcttttcatataagacaaatagtgctttaatgccaacttctttttatctcaacatttcaggatcatgctaggcacactgcccccttgaatagacattatatgcacagttgcaagtcagccaatgtttttattcagaagtatttccccccattatagtgcctgcatatcagagatacaaaaagcatccaacacactaccgtaataggcttctttggggatgagaaatttgagtctcaacaactcagagtttgagatgtcagcttttttggtaaacgtaggtgttagaggtatattttgctttcctacaacaattgttggcccttgatttcaagcatgttgcttcataggaagcaccagagtgccatctgctgcatttcaagagattgtaaatgtcatctcagctggctcagttatatctctaatgtcccgggtagcagcacctccctctaaaaatatgtttacttcactgtttcacttgtattttgtgtatacgaaatggcagcttccgatttctagttggatttgtcttgcattgtttgtataacttgctggtcacccagggctatttgctttttcattgagaaatttggtaggggtgtctagttcagcttttatgttgatccatcctgacttattttagacattgaatttatctcaccacaagtaaaagaacatgtgtattgactgtctttgctaagtttcctaatttttcctaattatggcaattatggatgtgaataagaatactgatgctgtacaaatatttttgtggaaatgtaccttgttaatgtgactatttaaataatatgaaaataagaatactcttgaagaaaaaattaaaatatttactctttgga

SEQ ID NO: 3 - DNA, 2665 bp, homo sapiens
  misc_feature: mRNA sequence of the human GSKIP gene
aaagtcaccacagttgatcatgtgaacagtgtcaagaatcaggccgaaccttcaaggagtttatgttctaaaacggaagcatggtggtacctgcttgtggaggctgaggcggaaggatcgcttgagcccaggactttgaggctgcataattgcattgacgctatccatagagtgcctgcaatttcaaatatcagaaaggatcgtacgagctatgatcatgccactgcactccagcctgaaccacagagcaagaccctttctctcaataaagtggaagtttgttcatttattcagtaaatatttattgattgccttctgtgtgccaagcactgttctaggtactgggattacagcagtgaacagataaatctcttccttcctggaacttacattttattgaagggaggagacatacaataaatgagtgaataatatgctttgtggtgataagggctgttggaaaaacgaaagcaatgtaaagggagtggagatggggaagagagaagggacttgccatttttatatgagatgctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaagaaaaaaa

SEQ ID NO: 4 - DNA, 1236 bp, homo sapiens
  misc_feature: mRNA sequence of TCL1A
ccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaaaaaaaaaaaaaaaaaaaa

SEQ ID NO: 5 - DNA, 1062 bp, homo sapiens
  misc_feature: mRNA sequence of the BDKRB1 gene
atggcatcatcctggccccctctagagctccaatcctccaaccagagccagctcttccctcaaaatgctacggcctgtgacaatgctccagaagcctgggacctgctgcacagagtgctgccgacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaa

SEQ ID NO: 6 - DNA, 1176 bp, homo sapiens
  misc_feature: mRNA sequence of the BDKRB2 gene
atgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtga

SEQ ID NO: 7 - DNA, 2100 bp, homo sapiens
  misc_feature: mRNA sequence of the AK7 gene
gttcgttgcaacaaattgatgagcaatgcttttttataatgccaactttgtacaaaaaagttggcatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaggtgaaggaaggcacattccagattgtgggcacgctgtccaagcctgacagcccgcggcctgactttgcggtggagacgtactctgccatctctcgagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggccagaaaatttgcagcatacgtagttgctgctggactccagtatggagcggaaggaggcatgttacacacattttttaagatggcttggttgggcgagattcctgcattaccagtttttggcgatggaacaaatgtaattccaacaatccatgttcttgatctagcaggagtgatacaaaacgtcatagatcacgtgccaaagcctcactacctggttgctgtggatgagtctgttcataccctggaagacatagtcaagtgtatcagtaaaaatactggccctgggaaaatccagaaaatacccagagaaaatgcatacctaaccaaggacttaacgcaagattgtcttgaccatttactggtcaacttgagaatggaagcgctctttgtgaaggagaattttaatattcgatgggctgcccaaacaggatttgtggaaaatatcaacactatcctcaaggagtacaagcaaagcagaggattgatgccaatcaagatctgcattcttggtccccctgctgtgggaaaatccagtattgctaaagaattggccaagtactacaaactgcatcacatccaactgaaggatgtcatttctgaagccatagcaaaactggaggcgattgttgcccctaacgatgtaggggaaggagaagaagaagtcgaagaggaagaggaggaggagaatgtggaagatgcacaggagctcctagatggcatcaaggagagcatggagcagaatgcaggtcaactagacgatcaatatataattagatttatgaaagaaaagctaaaatcaatgccttgcaggaatcaaggttatattttggatggattcccaaagacctatgatcaagcaaaagacctgttcaatcaggaagatgaggaggaggaagatgatgtcagaggcagaatgtttccctttgataaattaattatacctgaattcgtttgtgcactggatgcttcggatgagtttctgaaggagcgtgtgataaaccttcctgagagcatcgtggcggggacccactacagccaagaccgattcctccgggctctgagcaactaccgggacatcaatatcgacgatgagactgtcttcaactattttgatgaacttgaaattcacccgatacatattgatgtaggaaaacttgaagatgctcagaatagacttgctatcaaacagctcatcaaagagactggggagcctcgaaattatggtttaacagacgaagaaaaggcagaagaggagcggaaggctgcggaggagcggctggccagggaggctgctgaggaagcagaacgcgagcaccaggaggccgtggagatggcagagaagatagctcgctgggagtacccaactttcttgtacaaagttggcattataagaaagcattgcttatcaatttgttgcaacgaac

SEQ ID NO: 8 - protein, 2078 aa, homo sapiens
  MISC_FEATURE: protein sequence of the human ATG2B gene
MPWPFSESIKKRACRYLLQRYLGHFLQEKLSLEQLSLDLYQGTGSLAQVPLDKWCLNEILESADAPLEVTEGFIQSISLSVPWGSLLQDNCALEVRGLEMVFRPRPRPATGSEPMYWSSFMTSSMQLAKECLSQKLTDEQGEGSQPFEGLEKFAETIETVLRRVKVTFIDTVLRIEHVPENSKTGTALEIRIERTVYCDETADESSGINVHQPTAFAHKLLQLSGVSLFWDEFSASAKSSPVCSTAPVETEPKLSPSWNPKIIYEPHPQLTRNLPEIAPSDPVQIGRLIGRLELSLTLKQNEVLPGAKLDVDGQIDSIHLLLSPRQVHLLLDMLAAIAGPENSSKIGLANKDRKNRPMQQEDEYRIQMELNRYYLRKDSLSVGVSSEQSFYETETARTPSSREEEVFFSMADMDMSHSLSSLPPLGDPPNMDLELSLTSTYTNTPAGSPLSATVLQPTWGEFLDHHKEQPVRGSTFPSNLVHPTPLQKTSLPSRSVSVDESRPELIFRLAVGTFSISVLHIDPLSPPETSQNLNPLTPMAVAFFTCIEKIDPARFSTEDFKSFRAVFAEACSHDHLRFIGTGIKVSYEQRQRSASRYFSTDMSIGQMEFLECLFPTDFHSVPPHYTELLTFHSKEETGSHSPVCLQLHYKHSENRGPQGNQARLSSVPHKAELQIKLNPVCCELDISIVDRLNSLLQPQKLATVEMMASHMYTSYNKHISLHKAFTEVFLDDSHSPANCRISVQVATPALNLSVRFPIPDLRSDQERGPWFKKSLQKEILYLAFTDLEFKTEFIGGSTPEQIKLELTFRELIGSFQEEKGDPSIKFFHVSSGVDGDTTSSDDFDWPRIVLKINPPAMHSILERIAAEEEEENDGHYQEEEEGGAHSLKDVCDLRRPAPSPFSSRRVMFENEQMVMPGDPVEMTEFQDKAISNSHYVLELTLPNIYVTLPNKSFYEKLYNRIFNDLLLWEPTAPSPVETFENISYGIGLSVASQLINTFNKDSFSAFKSAVHYDEESGSEEETLQYFSTVDPNYRSRRKKKLDSQNKNSQSFLSVLLNINHGLIAVFTDVKQDNGDLLENKHGEFWLEFNSGSLFCVTKYEGFDDKHYICLHSSSFSLYHKGIVNGVILPTETRLPSSTRPHWLEPTIYSSEEDGLSKTSSDGVGGDSLNMLSVAVKILSDKSESNTKEFLIAVGLKGATLQHRMLPSGLSWHEQILYFLNIADEPVLGYNPPTSFTTFHVHLWSCALDYRPLYLPIRSLLTVETFSVSSSVALDKSSSTLRIILDEAALHLSDKCNTVTINLSRDYVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 9 - protein, 139 aa, homo sapiens
  MISC_FEATURE: protein sequence of the human GSKIP gene
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 10 - protein, 114 aa, homo sapiens [sequence omitted]

SEQ ID NO: 11 - protein, 353 aa, homo sapiens
  MISC_FEATURE: protein sequence of the human BDKRB1 gene
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 12 - protein, 391 aa, homo sapiens
  MISC_FEATURE: protein sequence of the human BDKRB1 gene
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 13 - protein, 723 aa, homo sapiens
  MISC_FEATURE: protein sequence of the human AK7 gene
MAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISREDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKARKFAAYVVAAGLQYGAEGGMLHTFFKMAWLGEIPALPVFGDGTNVIPTIHVLDLAGVIQNVIDHVPKPHYLVAVDESVHTLEDIVKCISKNTGPGKIQKIPRENAYLTKDLTQDCLDHLLVNLRMEALFVKENFNIRWAAQTGFVENINTILKEYKQSRGLMPIKICILGPPAVGKSSIAKELANYYKLHHIQLKDVISEAIAKLEAIVAPNDVGEGEEEVEEEEEEENVEDAQELLDGIKESMEQNAGQLDDQYIIRFMKEKLKSMPCRNQGYILDGFPKTYDQAKDLFNQEDEEEEDDVRGRMFPFDKLIIPEFVCALDASDEFLKERVINLPESIVAGTHYSQDRFLRALSNYRDINIDDETVFNYFDELEIHPIHIDVGKLEDAQNRLAIKQLIKEIGEPRNYGLTDEEKAEEERKAAEERLAREAAEEAEREHQEAVEMAEKIARWEEWNKRLEEVKREERELLEAQSIPLRNYLMTYVMPTLIQGLNECCNVRPEDPVDFLAEYLFKNNPEAQ

SEQ ID NO: 14 - DNA, 962 bp, homo sapiens
  misc_feature: nucleotide sequence of the CNV junction
aaggacaccagttgttggatgaggactcaccctatccaatatggcttcattttaacttgattacatctgcaaagaccctatttccaaataaggccacattcacaggttctaagaggacaggaatttggtgggggtagacgctatttaacccagtgtaccatctaaaatgcatccatcaaaaaacagagatttagggtgggcgtggtgtaatactagcactttgggaggccgaggtgggtggatcacctgaggtcaggagttcgagaccagcctggccaacatagtgaaaccctgtctctactaaaagtacaaaaattaaccgggcgtggtggcaggcgcctataatctcagctgctctggaggctgaggcaggaaaatcacttgaacccagggggcggaggttgcagtgagccgagattgcaccacttcgctccagcctgggcaacagagtgaaactccatctcaaaaaaaaaagctagaattaagactcataagaaaactaaccaaaattggcagcagcagatatggacaggaggagagaggaagcacaaggatgctgtttcctcatccttcacaggggacagttgggagaggtcgtagaacaataaacagaacggccacataaaagctctaaaaggccgggcgtggtggctacatgcctgtaatcccagcactttgggaggctgaggccggtgaatcatttgaggtcaggagttcgagaccagcctggcccacacggtgaaaccccgtctctaataagaatacaaaaattagccgggcggtcgtagcgcacgcctgtaatcccagttactcgggaggctgaggcaggggaatcgcttgagcctgggaggcggaaattgcagtgaggtgagatcacgcccctacactccagtctgggtgacagagtgagaccctgtctcagaaaaatgataaaagctctacaggtgcaattcagaccttct

SEQ ID NO: 15 - DNA, 47 bp, artificial
  shRNA against ATG2B
atgcaatactgtcactataaactcgagtttatagtgacagtattgca

SEQ ID NO: 16 - DNA, 48 bp, artificial
  shRNA against GSKIP
ggacaaactttgtagtaattactcgagtaattactacaaagtttgtcc

SEQ ID NO: 17 - DNA, 21 bp, artificial
  primer Chr14_B1-C1F
atgctcttgcagctactcagc

SEQ ID NO: 18 - DNA, 21 bp, artificial
  primer Chr14_B1-C1R
cggcaaaatctctccttctct

SEQ ID NO: 19 - DNA, 21 bp, artificial
  primer Chr14_B1-C2F
ttcctacccacagaaatgtgc

SEQ ID NO: 20 - DNA, 21 bp, artificial
  primer Chr14_B1-C2R
  misc_feature: primer Chr14_B1-C2R
aagaaggcagctaagggactg

SEQ ID NO: 21 - DNA, 21 bp, artificial
  primer Chr14_B1-C2.1F
gagtcacactttgggatctgc

SEQ ID NO: 22 - DNA, 21 bp, artificial
  primer Chr14_B1-C2.1R
taacagttggggcagaacaag

SEQ ID NO: 23 - DNA, 21 bp, artificial
  primer Chr14_B1-C2.2F
  misc_feature: primer Chr14_B1-C2.2F
cccacccaaactaatctgtga

SEQ ID NO: 24 - DNA, 21 bp, artificial
  primer Chr14_B1-C2.2R
taggacgcagacacacacaag

SEQ ID NO: 25 - DNA, 21 bp, artificial
  primer Chr14_B1-C2.3F
ggaaattgcagtgaggtgaga

SEQ ID NO: 26 - DNA, 21 bp, artificial
  primer Chr14_B1-C2.3R
agaaggtctgaattgcacctg

SEQ ID NO: 27 - DNA, 21 bp, artificial
  primer Chr14_B1-C3F
ctttcctggtcacattttcca

SEQ ID NO: 28 - DNA, 21 bp, artificial
  primer Chr14_B1-C3R
ttagcattttcagctgggcta

SEQ ID NO: 29 - DNA, 21 bp, artificial
  primer Chr14_B2-C1F
caccaatccttgctgagttgt

SEQ ID NO: 30 - DNA, 21 bp, artificial
  primer Chr14_B2-C1R
cattagtagcagccgaacctg

SEQ ID NO: 31 - DNA, 21 bp, artificial
  primer Chr14_B2-C2F
ggacttgcccaagatcacata

SEQ ID NO: 32 - DNA, 21 bp, artificial
  primer Chr14_B2-C2R
ttagctgcctgcttcaaaatc

SEQ ID NO: 33 - DNA, 21 bp, artificial
  primer Chr14_B2-C2.1F
aaggacaccagttgttggatg

SEQ ID NO: 34 - DNA, 21 bp, artificial
  primer Chr14_B2-C2.1R
gaacctgtgaatgtggcctta

SEQ ID NO: 35 - DNA, 21 bp, artificial
  primer Chr14_B2-C2.2F
gccaggagtttggtttatcct

SEQ ID NO: 36 - DNA, 21 bp, artificial
  primer Chr14_B2-C2.2R
tgcccagcctgtatctgtatc

SEQ ID NO: 37 - DNA, 21 bp, artificial
  primer Chr14_B2-C2.3F
aggcagaggatgaagaagagg

SEQ ID NO: 38 - DNA, 21 bp, artificial
  primer Chr14_B2-C2.3R
caggtgacccttgaacaacac

SEQ ID NO: 39 - DNA, 21 bp, artificial
  primer Chr14_B2-C3F
aggcaacatagcaagaccaca

SEQ ID NO: 40 - DNA, 21 bp, artificial
  primer Chr14_B2-C3R
aggaactcagggtcagagagc

SEQ ID NO: 41 - DNA, 21 bp, artificial
  primer Chr14_dup_joncF
tgggcgtggtgtaatactagc

SEQ ID NO: 42 - DNA, 21 bp, artificial
  primer Chr14_dup_joncR
tggccgttctgtttattgttc

SEQ ID NO: 43 - DNA, 21 bp, artificial
  primer ATG2B_ex36F
gtctcctggagctgatgtcac

SEQ ID NO: 44 - DNA, 21 bp, artificial
  primer ATG2B_ex36R
gccattaaccacttccactga

SEQ ID NO: 45 - DNA, 21 bp, artificial
  primer TCL1A_ex2F
tacagttacgggtgctcttgc

SEQ ID NO: 46 - DNA, 21 bp, artificial
  primer TCL1A_ex2R
gggtagagctgccacatgata

SEQ ID NO: 47 - DNA, 22 bp, artificial
  primer HBB_F
gtgcacctgactcctgaggaga

SEQ ID NO: 48 - DNA, 21 bp, artificial
  primer HBB_R
ccttgataccaacctgcccag

The invention claimed is:

1. An in vitro method comprising:
   a) obtaining a biological sample of a human subject suffering from essential thrombocythemia,
   b) analyzing the copy number of a genomic region having at least 20 consecutive nucleotides of SEQ ID NO:1 in said biological sample, to detect that at least two copy numbers are present in said biological sample.

2. The method of claim 1, wherein said biological sample is a blood sample.

3. The method of claim 1, wherein said genomic region contains the GSKIP gene of SEQ ID NO:3 or the ATG2B gene of SEQ ID NO:2.

4. The method of claim 1, wherein step b) comprises analyzing the expression of mRNA transcript of the GSKIP gene and/or of the ATG2B gene.

5. The method of claim 1, wherein step b) comprises assessing expression level of GSKIP protein (SEQ ID NO:9) and/or of ATG2B protein (SEQ ID NO:8).

6. The method of claim 1, wherein step b) comprises fluorescent in situ hybridization, comparative genomic hybridization, array comparative genomic hybridization, virtual karyotyping with SNP arrays, or next-generation sequencing.

7. The method of claim 1, comprising use of a kit comprising:
   one set of primers amplifying specifically SEQ ID NO:14,
   one probe hybridizing specifically SEQ ID NO:14, two sets of primers amplifying specifically SEQ ID NO:2 and SEQ ID NO:3 respectively, at least two probes hybridizing specifically SEQ ID NO:2 and SEQ ID NO:3 respectively, or any combination of said primers and probes.

8. The method of claim 1, wherein in step b) at least three copy numbers are detected.

9. The method of claim 1, wherein said genomic region contains two fragments of SEQ ID NO: 1, each having at least 20 consecutive nucleotides of SEQ ID NO:1.

10. The method of claim 9, wherein said genomic region is SEQ ID NO:14.

11. A method for delaying the progression of a Essential Thrombocytopenia (ET) into a myelofibrosis (MF), a myelodysplastic syndrome (MDS) or an acute myeloid leukemia (AML), comprising administering to a patient having at least two copy numbers of a genomic region having at least 20 consecutive nucleotides of SEQ ID NO: 1, and having ET, anti-sense nucleic acids inhibiting the expression of ATG2B gene of SEQ ID NO:2 and of GSKIP gene of SEQ ID NO:3, said anti-sense nucleic acids being short interfering RNA (siRNA), double-stranded RNA (dsRNA), micro-RNA (miRNA), or short-hairpin RNA (shRNA).

12. The method of claim 11, wherein said anti-sense nucleic acid is SEQ ID NO:15 or SEQ ID NO:16.

* * * * *